US010865414B2

(12) United States Patent
Freier

(10) Patent No.: US 10,865,414 B2
(45) Date of Patent: Dec. 15, 2020

(54) MODULATORS OF DNM2 EXPRESSION

(71) Applicant: Ionis Pharmaceuticals, Inc., Carlsbad, CA (US)

(72) Inventor: Susan M. Freier, San Diego, CA (US)

(73) Assignee: Ionis Pharmaceuticals, Inc., Carlsbad, CA (US)

(*) Notice: Subject to any disclaimer, the term of this patent is extended or adjusted under 35 U.S.C. 154(b) by 0 days.

(21) Appl. No.: 16/248,549

(22) Filed: Jan. 15, 2019

(65) Prior Publication Data

US 2019/0241896 A1    Aug. 8, 2019

Related U.S. Application Data

(60) Provisional application No. 62/617,411, filed on Jan. 15, 2018.

(51) Int. Cl.
*C12N 15/113*    (2010.01)

(52) U.S. Cl.
CPC ........ *C12N 15/1137* (2013.01); *C12N 15/113* (2013.01); *C12N 2310/11* (2013.01); *C12N 2310/14* (2013.01); *C12N 2310/315* (2013.01); *C12N 2310/3231* (2013.01); *C12N 2310/334* (2013.01); *C12N 2310/3341* (2013.01); *C12N 2310/341* (2013.01); *C12N 2310/346* (2013.01); *C12N 2310/351* (2013.01); *C12N 2320/35* (2013.01)

(58) Field of Classification Search
None
See application file for complete search history.

(56) References Cited

U.S. PATENT DOCUMENTS

| | | | |
|---|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |

(Continued)

FOREIGN PATENT DOCUMENTS

| WO | WO 2016/170162 | 10/1916 |
|---|---|---|
| WO | 2012058268 A2 | 5/2012 |

(Continued)

OTHER PUBLICATIONS

International Search Report and Written Opinion for International Application No. PCT/US2019/013689, dated May 2, 2019.
Branch et al., "A good antisense molecule is hard to find," TIBS (1998) 23:45-50.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

(Continued)

*Primary Examiner* — Tracy Vivlemore

(74) *Attorney, Agent, or Firm* — Lathrop GPM LLP; James H. Velema, Esq.; Laura A. Labeots, Esq.

(57) ABSTRACT

The present embodiments provide methods, compounds, and compositions useful for inhibiting DNM2 expression, which may be useful for treating, preventing, or ameliorating a disease associated with DNM2.

49 Claims, No Drawings

Specification includes a Sequence Listing.

(56) References Cited

U.S. PATENT DOCUMENTS

| | | |
|---|---|---|
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,770,748 B2 | 8/2004 | Imanishi et al. |
| 7,015,315 B1 | 3/2006 | Cook et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2005/0130923 A1 | 6/2005 | Bhat et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |
| 2010/0190837 A1 | 7/2010 | Migawa et al. |
| 2010/0197762 A1 | 8/2010 | Swayze et al. |
| 2013/0130378 A1 | 5/2013 | Manoharan et al. |
| 2014/0107330 A1 | 4/2014 | Freier et al. |
| 2014/0161894 A1* | 6/2014 | MacLachlan ........ C12N 15/113 424/498 |
| 2015/0018540 A1 | 1/2015 | Prakash et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |

FOREIGN PATENT DOCUMENTS

| | | | |
|---|---|---|---|
| WO | WO 2015/055859 | 4/2015 | |
| WO | WO-2015107425 A2 * | 7/2015 | ........... C12N 15/113 |

OTHER PUBLICATIONS

Cowling et al., "Reducing dynamin 2 expression rescues X-linked centronuclear myopathy" J. Clin. Invest. (2014) 124: 1350-1363.

(56) References Cited

OTHER PUBLICATIONS

Crooke et al., "Basic Principles of Antisense Therapeutics" Antisense Research and Application (1998) Chapter 1:1-50.
Crooke, ST., et al., "Antisense Drug Technology" Second Edition, CRC Press (2008) Chapters 1-28.
Durieux et al., "Dynamin 2 and human diseases" J Mol Med (2010) 88: 339-350.
Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.
Gautschi et al., "Activity of a novel bcl-2/bcl-xLbispecific antisense oligonucleotide against tumors of diverse histologic origins" J. Natl. Cancer Inst. (2001) 93:463-471.
Maher et al., "Comparative hybrid arrest by tandem antisense oligodeoxyribonucleotides or oligodeoxyribonucleoside methylpbosphonates in a cell-free system" Nucl. Acid. Res. (1988) 16(8):3341-3358.
New England Biolabs 1998/99 Catalog (cover page and pp. 121 and 284).
Reynolds et al., "Rational siRNA design for RNA interference" Nature Biotechnology (2004) 22(3):326-330.
Sanghvi et al., "Heterocyclic Base Modifications in Nucleic Acids and Their Applications in Antisense Oligonucleotides" Antisense Research and Applications (1993) pp. 273-288.
Seth et al., "Short Antisense Oligonucleotides with Novel 2'-4' Conformationaly Restricted Nucleoside Analogues Show Improved Potency Without Increased Toxicity in Animals " J Med Chem (2009) 52:10-13.
Tasfaout et al. "Antisense oligonucleotide-mediated Dnm2 knockdown prevents and reverts myotubular myopathy in mice" Nat. Commun. (2017) 8: 15661.
Woolf et al., "Specificity of antisense oligonucleotides in vivo" PNAS (1992) 89: 7305-7309.

* cited by examiner

MODULATORS OF DNM2 EXPRESSION

SEQUENCE LISTING

The present application is being filed along with a Sequence Listing in electronic format. The Sequence Listing is provided as a file entitled BIOL0322USSEQ_ST25.txt created Jan. 14, 2019 which is 784 kb in size. The information in the electronic format of the sequence listing is incorporated herein by reference in its entirety.

FIELD

The present embodiments provide methods, compounds, and compositions useful for inhibiting DNM2 expression, which can be useful for treating, preventing, or ameliorating a disease associated with DNM2.

BACKGROUND

Dynamin 2 (DNM2) is a large GTPase that is involved in membrane trafficking and microtubule dynamics (See, e.g., Durieux et al. *J Mol Med,* 88, 339 (2010)). Mutations in DNM2 are associated with several diseases, including centronuclear myopathy (CNM) and Charcot-Marie-Tooth disease. DNM2 is also associated with Duchenne's Muscular Dystrophy (See, e.g., WO 2015/055859 and WO 2016/170162). CNM and CNM-like myopathy are also associated with mutations in MTM1, BIN1, RYR1, TTN, CCDC78, and MTMR14

SUMMARY

Certain embodiments provided herein are directed to potent and tolerable compounds and compositions useful for inhibiting DNM2 expression, which can be useful for treating, preventing, ameliorating, or slowing progression of diseases, such as centronuclear myopathy (CNM), Charcot-Marie-Tooth disease (CMT), and Duchenne's Muscular Dystrophy (DMD). Certain embodiments provided herein comprise modified oligonucleotides complementary to a DNM2 nucleic acid that potently reduce DNM2 expression in animals.

One object of the present invention is a compound comprising a modified oligonucleotide 8 to 50 linked nucleosides in length having a nucleobase sequence comprising at least 8 contiguous nucleobases of any of the nucleobase sequences of SEQ ID NOs: 7-3134. Another object of the present invention is a compound comprising a modified oligonucleotide 9 to 50 linked nucleosides in length having a nucleobase sequence comprising at least 9 contiguous nucleobases of any of the nucleobase sequences of SEQ ID NOs: 7-3134. Another object of the present invention is a compound comprising a modified oligonucleotide 10 to 50 linked nucleosides in length having a nucleobase sequence comprising at least 10 contiguous nucleobases of any of the nucleobase sequences of SEQ ID NOs: 7-3134. Another object of the present invention is a compound comprising a modified oligonucleotide 11 to 50 linked nucleosides in length having a nucleobase sequence comprising at least 11 contiguous nucleobases of any of the nucleobase sequences of SEQ ID NOs: 7-3134. Another object of the present invention is a compound comprising a modified oligonucleotide 12 to 50 linked nucleosides in length having a nucleobase sequence comprising at least 12, at least 13, at least 14, or at least 15 contiguous nucleobases of any of the nucleobase sequences of SEQ ID NOs: 7-3134. Another object of the present invention is a compound comprising a modified oligonucleotide 16 to 50 linked nucleosides in length having a nucleobase sequence comprising the nucleobase sequence of any of SEQ ID NOs: 7-3134. Another object of the present invention is a compound comprising a modified oligonucleotide having a nucleobase sequence consisting of any one of SEQ ID NOs: 7-3134. Another object of the present invention is a compound comprising a modified oligonucleotide 8 to 50 linked nucleosides in length complementary within nucleobases 3,404-44,737; 83,573-87,287; 87,359-90,915; 90,968-97,263; 97,378-104,979; 81,061-81,199; or 116,048-116,903 of SEQ ID NO: 1, wherein said modified oligonucleotide is at least 85%, 90%, 95%, or 100% complementary to SEQ ID NO: 1. Another object of the present invention is a compound comprising a modified oligonucleotide 8 to 50 linked nucleosides in length having a nucleobase sequence comprising a portion of at least 8 contiguous nucleobases 100% complementary to an equal length portion of nucleobases 3,404-44,737; 83,573-87,287; 87,359-90,915; 90,968-97,263; 97,378-104,979; 81,061-81,199; or 116,048-116,903 of SEQ ID NO: 1, wherein the nucleobase sequence of the modified oligonucleotide is at least 85%, 90%, 95%, or 100% complementary to SEQ ID NO: 1. Another object of the present invention is a compound comprising a modified oligonucleotide 8 to 50 linked nucleosides in length complementary within nucleobases 83,573-87,287 or 87,359-90,915 of SEQ ID NO: 1, wherein said modified oligonucleotide is at least 85%, 90%, 95%, or 100% complementary to SEQ ID NO: 1. Another object of the present invention is a compound comprising a modified oligonucleotide complementary to intron 1 of a human DNM2 pre-mRNA. Another object of the present invention is a compound comprising a modified oligonucleotide complementary to intron 11 of a human DNM2 pre-mRNA. Another object of the present invention is a compound comprising a modified oligonucleotide complementary to intron 12 of a human DNM2 pre-mRNA. Another object of the present invention is a compound comprising a modified oligonucleotide complementary to intron 13 of a human DNM2 pre-mRNA. Another object of the present invention is a compound comprising a modified oligonucleotide complementary to intron 14 of a human DNM2 pre-mRNA. Another object of the present invention is a compound comprising a modified oligonucleotide complementary to exon 10 of a human DNM2 pre-mRNA or human DNM2 mRNA. Another object of the present invention is a compound comprising a modified oligonucleotide complementary to the 3'-UTR of a human DNM2 pre-mRNA or human DNM2 mRNA. Another object of the present invention is a compound comprising a modified oligonucleotide 16 to 50 linked nucleosides in length having a nucleobase sequence comprising any of SEQ ID NOs: 2879, 3056, 2123, 2189, 2453, 2160, or 2232. Another object of the present invention is a compound comprising a modified oligonucleotide having a nucleobase sequence consisting of any one of SEQ ID NOs: 2879, 3056, 2123, 2189, 2453, 2160, or 2232. Another object of the present invention is a compound comprising a modified oligonucleotide having a nucleobase sequence comprising SEQ ID NO: 2879.

Another object of the present invention is a compound comprising a modified oligonucleotide 16 to 50 linked nucleosides in length having a nucleobase sequence comprising any of SEQ ID NOs: 2879, 3056, 2123, 2189, 2453, 2160, or 2232, wherein the modified oligonucleotide comprises:

a gap segment consisting of 8-12 linked 2'-deoxynucleosides;
a 5' wing segment consisting of 1-7 linked nucleosides; and
a 3' wing segment consisting of 1-7 linked nucleosides;
wherein the gap segment is positioned between the 5' wing segment and the 3' wing segment and wherein each terminal wing nucleoside comprises a modified sugar.

Another object of the present invention is a compound comprising a modified oligonucleotide 16 linked nucleosides in length having a nucleobase sequence consisting of the sequence recited in SEQ ID NO: 2879, 3056, 2123, 2189, 2453, 2160, or 2232, wherein the modified oligonucleotide comprises
a gap segment consisting of 10 linked 2'-deoxynucleosides;
a 5' wing segment consisting of 3 linked nucleosides; and
a 3' wing segment consisting of 3 linked nucleosides;
wherein the gap segment is positioned between the 5' wing segment and the 3' wing segment; wherein each nucleoside of each wing segment comprises a cEt sugar moiety; wherein each internucleoside linkage is a phosphorothioate linkage; and wherein each cytosine is a 5-methylcytosine.

In one embodiment, the oligonucleotide is at least 80%, 85%, 90%, 95% or 100% complementary to any of SEQ ID NO: 1, 2, 3, or 3135. In one embodiment, the modified oligonucleotide comprises at least one modified internucleoside linkage. In one embodiment, the at least one modified internucleoside linkage is a phosphorothioate internucleoside linkage. In one embodiment, the modified oligonucleotide comprises at least one bicyclic sugar. In one embodiment, the at least one bicyclic sugar is selected from the group consisting of LNA, ENA, and cEt. In one embodiment, the at least one bicyclic sugar moiety is a cEt sugar moiety.

In one embodiment, the modified oligonucleotide comprises at least one 5-methylcytosine. In one embodiment, the modified oligonucleotide comprises:

a gap segment consisting of linked 2'-deoxynucleosides;
a 5' wing segment consisting of linked nucleosides; and
a 3' wing segment consisting of linked nucleosides;
wherein the gap segment is positioned immediately adjacent to and between the 5' wing segment and the 3' wing segment and wherein each nucleoside of each wing segment comprises a modified sugar moiety.

In one embodiment, the compound is single-stranded. In one embodiment, the compound is double-stranded.

In one embodiment, the compound comprises at least one unmodified ribosyl sugar moiety. In one embodiment, the compound comprises at least one unmodified 2'-deoxyribosyl sugar moiety.

In one embodiment, the modified oligonucleotide consists of 10 to 30 linked nucleosides. In one embodiment, the modified oligonucleotide consists of 12 to 30 linked nucleosides. In one embodiment, the modified oligonucleotide consists of 15 to 30 linked nucleosides. In one embodiment, the modified oligonucleotide consists of 16 to 20 linked nucleosides.

Another object of the present invention is a compound comprising a modified oligonucleotide according to the following formula: Gks Tks Tks Tds Ads Tds Tds Ads Tds Ads Gds Gds Gds mCks Tks Tk; wherein,
A=an adenine,
mC=a 5-methylcytosine
G=a guanine,
T=a thymine,
k=a cEt sugar moiety,
d=a 2'-deoxyribosyl sugar moiety, and
s=a phosphorothioate internucleoside linkage.

In one embodiment, the compound of the invention comprises a conjugate group. In one embodiment, the compound of the invention consists of the modified oligonucleotide and the conjugate group.

Another object of the present invention is a compound according to the following formula:

[SEQ ID NO: 2879]

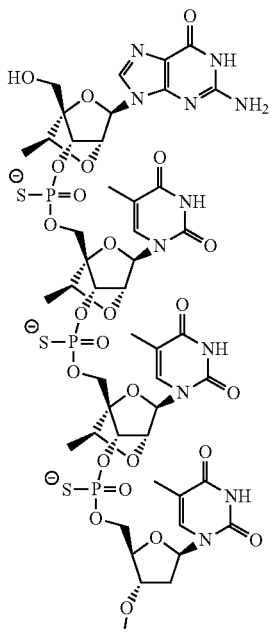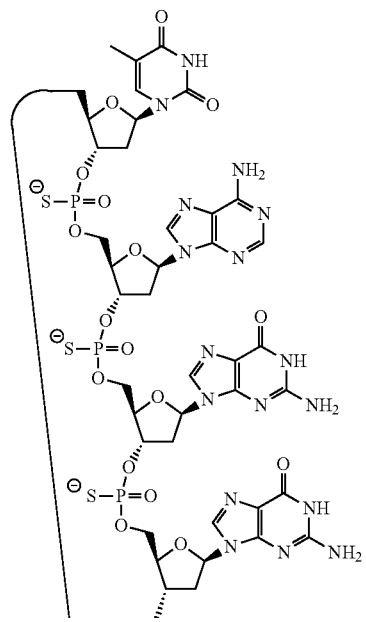

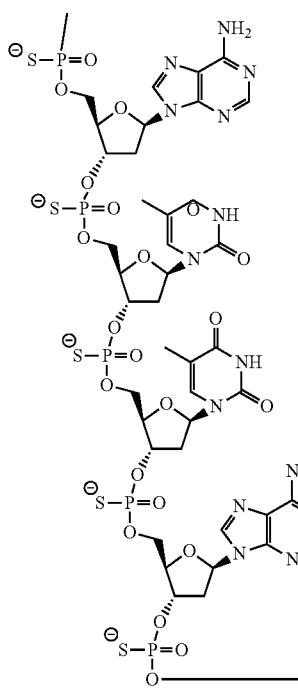
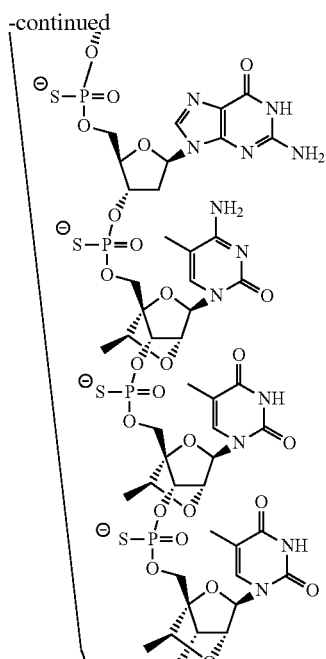

or a salt thereof.

In one embodiment, the compound consists of the modified oligonucleotide.

The present invention further relates to a compound consisting of a pharmaceutically acceptable salt form of any one of the compounds described herein. In one embodiment, the pharmaceutically acceptable salt is a sodium salt. In one embodiment, the pharmaceutically acceptable salt is a potassium salt.

The present invention also relates to a pharmaceutical composition comprising a compound as described herein and at least one pharmaceutically acceptable carrier or diluent.

The present invention further relates to a chirally enriched population of the compounds described herein, wherein the population is enriched for modified oligonucleotides comprising at least one particular phosphorothioate internucleoside linkage having a particular stereochemical configuration. In one embodiment, the population is enriched for modified oligonucleotides comprising at least one particular phosphorothioate internucleoside linkage having the (Sp) configuration. In one embodiment, the population is enriched for modified oligonucleotides comprising at least one particular phosphorothioate internucleoside linkage having the (Rp) configuration. In one embodiment, the population is enriched for modified oligonucleotides having a particular, independently selected stereochemical configuration at each phosphorothioate internucleoside linkage. In one embodiment, the population is enriched for modified oligonucleotides having the (Sp) configuration at each phosphorothioate internucleoside linkage. In one embodiment, the population is enriched for modified oligonucleotides having the (Rp) configuration at each phosphorothioate internucleoside linkage. In one embodiment, the population is enriched for modified oligonucleotides having the (Rp) configuration at one particular phosphorothioate internucleoside linkage and the (Sp) configuration at each of the remaining phosphorothioate internucleoside linkages. In one embodiment, the population is enriched for modified oligonucleotides having at least 3 contiguous phosphorothioate internucleoside linkages in the Sp, Sp, and Rp configurations, in the 5' to 3' direction. In one embodiment, all of the phosphorothioate internucleoside linkages of the modified oligonucleotide are stereorandom.

The present invention further relates to a pharmaceutical composition comprising the population of compounds described herein and at least one pharmaceutically acceptable diluent or carrier.

The present invention further relates to a compound described herein, a pharmaceutical composition comprising said compound and at least one pharmaceutically acceptable carrier or diluent, or a pharmaceutical composition comprising the population of compounds described herein and at least one pharmaceutically acceptable carrier or diluent, for use in therapy.

The present invention further relates to a compound described herein, a pharmaceutical composition comprising said compound and at least one pharmaceutically acceptable carrier or diluent, or a pharmaceutical composition comprising the population of compounds described herein and at least one pharmaceutically acceptable carrier or diluent, for use in treating, preventing, or ameliorating centronuclear myopathy, Duchenne Muscular Dystrophy, or Charcot-Marie Tooth disease.

The present invention also relates to a method of treating, preventing, or ameliorating a disease associated with DNM2 in an individual comprising administering to the individual a compound or composition described herein, thereby treating, preventing, or ameliorating the disease.

The present invention also relates to a method of treating, preventing, or ameliorating a disease associated with DNM2 in an individual comprising administering to the individual a compound comprising a modified oligonucleotide 100% complementary to an exon 10, an intron, or the 3'-UTR of a DNM2 nucleic acid transcript, thereby treating, preventing, or ameliorating the disease.

In one embodiment, the disease is centronuclear myopathy, Duchenne Muscular Dystrophy, or Charcot-Marie Tooth disease. In one embodiment, the compound is single-stranded. In one embodiment, the DNM2 nucleic acid transcript is a pre-mRNA. In one embodiment, the disease is X-linked myotubular myopathy, autosomal recessive centronuclear myopathy, or autosomal dominant centronuclear myopathy. In one embodiment, the individual has at least one mutation in at least one gene selected from among MTM1, BIN1, and DNM2. In one embodiment, the administering increases body weight or muscle strength.

The present invention further relates to a method of inhibiting expression of DNM2 in a cell comprising contacting the cell with a single-stranded compound comprising a modified oligonucleotide 100% complementary to exon 10, an intron, or the 3'-UTR of a DNM2 nucleic acid transcript, thereby inhibiting expression of DNM2 in the cell. In one embodiment, the method is an in vitro method. In one embodiment, the cell is in the muscle of an individual. In one embodiment, the individual has, or is at risk of having, a centronuclear myopathy, Duchenne Muscular Dystrophy, or Charcot-Marie Tooth disease. The present invention further relates to a method of increasing body weight or muscle strength in an individual having, or at risk of having, a disease associated with DNM2 comprising administering a single-stranded compound comprising a modified oligonucleotide 100% complementary to a DNM2 nucleic acid transcript to the individual, thereby increasing body weight or muscle strength in the individual. In one embodiment, the individual has, or is at risk of having, centronuclear myopathy, Duchenne Muscular Dystrophy, or Charcot-Marie Tooth disease.

In one embodiment, the compound is a compound as described herein. In one embodiment, the compound is a member of the chirally enriched population described herein. In one embodiment, the compound is a component of the pharmaceutical composition described herein.

In one embodiment, the compound is administered to the individual via subcutaneous injection. In one embodiment, the compound is administered to the individual via intramuscular injection. In one embodiment, the compound is administered to the individual via intravenous injection.

The present invention further relates to the use of a single-stranded compound comprising a modified oligonucleotide 100% complementary to exon 10, intron 1, intron 11, intron, 12, intron 13, intron 14, or the 3'-UTR of a DNM2 nucleic acid transcript for treating, preventing, or ameliorating a disease associated with DNM2. In one embodiment, the disease is centronuclear myopathy, Duchenne Muscular Dystrophy, or Charcot-Marie Tooth disease.

The present invention further relates to the use of the compound described herein or the composition described herein for treating, preventing, or ameliorating a disease associated with DNM2.

The present invention further relates to the use of the compound described herein or the composition described herein in the manufacture of a medicament for treating, preventing, or ameliorating a disease associated with DNM2.

In one embodiment, the disease is centronuclear myopathy, Duchenne Muscular Dystrophy, or Charcot-Marie Tooth disease. In one embodiment, the disease is X-linked myotubular myopathy, autosomal recessive centronuclear myopathy, or autosomal dominant centronuclear myopathy. In one embodiment, the disease is associated with a mutation in at least one gene selected from among MTM1, BIN1, and DNM2.

The present invention further relates to the use of the compound described herein or the composition described herein in the preparation of a medicament for treating, preventing, or ameliorating a disease associated with DNM2. In one embodiment, the disease is centronuclear myopathy, Duchenne Muscular Dystrophy, or Charcot-Marie Tooth disease. In one embodiment, the disease is X-linked myotubular myopathy, autosomal recessive centronuclear myopathy, or autosomal dominant centronuclear myopathy. In one embodiment, the disease is associated with a mutation in at least one gene selected from among MTM1, BIN1, and DNM2.

DETAILED DESCRIPTION

It is to be understood that both the foregoing general description and the following detailed description are exemplary and explanatory only and are not restrictive of the embodiments, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting.

The section headings used herein are for organizational purposes only and are not to be construed as limiting the subject matter described. All documents, or portions of documents, cited in this application, including, but not limited to, patents, patent applications, articles, books, treatises, and GenBank and NCBI reference sequence records are hereby expressly incorporated by reference for the portions of the document discussed herein, as well as in their entirety.

It is understood that the sequence set forth in each SEQ ID NO contained herein is independent of any modification to a sugar moiety, an internucleoside linkage, or a nucleobase. As such, compounds defined by a SEQ ID NO may comprise, independently, one or more modifications to a sugar moiety, an internucleoside linkage, or a nucleobase.

As used herein, "2'-deoxynucleoside" means a nucleoside comprising 2'-H(H) ribosyl sugar moiety, as found in naturally occurring deoxyribonucleic acids (DNA). In certain embodiments, a 2'-deoxynucleoside may comprise a modified nucleobase or may comprise an RNA nucleobase (uracil).

As used herein, "2'-substituted nucleoside" or "2-modified nucleoside" means a nucleoside comprising a 2'-substituted or 2'-modified sugar moiety. As used herein, "2'-substituted" or "2-modified" in reference to a furanosyl sugar moiety means a sugar moiety comprising at least one 2'-substituent group other than H or OH.

As used herein, "administration" or "administering" refers to routes of introducing a compound or composition provided herein to an individual to perform its intended function. An example of a route of administration that can be used includes, but is not limited to, administration by inhalation.

As used herein, "administered concomitantly" or "co-administration" means administration of two or more compounds in any manner in which the pharmacological effects of both are manifest in the patient. Concomitant administration does not require that both compounds be administered in a single pharmaceutical composition, in the same dosage form, by the same route of administration, or at the same time. The effects of both compounds need not manifest themselves at the same time. The effects need only be overlapping for a period of time and need not be coextensive. Concomitant administration or co-administration encompasses administration in parallel or sequentially.

As used herein, "animal" refers to a human or non-human animal, including, but not limited to, mice, rats, rabbits, dogs, cats, pigs, and non-human primates, including, but not limited to, monkeys and chimpanzees.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means a compound comprising an antisense oligonucleotide and optionally one or more additional features, such as a conjugate group or terminal group.

As used herein, "antisense oligonucleotide" means an oligonucleotide having a nucleobase sequence that is at least partially complementary to a target nucleic acid.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom.

As used herein, "bicyclic nucleoside" or "BNA" means a nucleoside comprising a bicyclic sugar moiety. As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cEt" or "constrained ethyl" means a bicyclic sugar moiety, wherein the first ring of the bicyclic sugar moiety is a ribosyl sugar moiety, the second ring of the bicyclic sugar is formed via a bridge connecting the 4'-carbon and the 2'-carbon, the bridge has the formula 4'-CH($CH_3$)—O-2', and the methyl group of the bridge is in the S configuration. A cEt bicyclic sugar moiety is in the β-D configuration.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more sterorandom chiral centers. In certain embodiments, the molecules are modified oligonucleotides. In certain embodiments, the molecules are compounds comprising modified oligonucleotides.

As used herein, "complementary" in reference to an oligonucleotide means that at least 70% of the nucleobases of such oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases are nucleobase pairs that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or nucleic acids need not have nucleobase complementarity at each nucleoside. Rather, some mismatches are tolerated. As used herein, "fully complementary" or "100% complementary" in reference to oligonucleotides means that such oligonucleotides are complementary to another oligonucleotide or nucleic acid at each nucleoside of the oligonucleotide.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "double-stranded antisense compound" means an antisense compound comprising two oligomeric compounds that are complementary to each other and form a duplex, and wherein one of the two said oligomeric compounds comprises an antisense oligonucleotide.

As used herein, "effective amount" means the amount of compound sufficient to effectuate a desired physiological outcome in an individual in need of the compound. The effective amount may vary among individuals depending on the health and physical condition of the individual to be treated, the taxonomic group of the individuals to be treated, the formulation of the composition, assessment of the individual's medical condition, and other relevant factors.

As used herein, "efficacy" means the ability to produce a desired effect.

As used herein "DNM2" means any Dynamin 2 nucleic acid or protein. "DNM2 nucleic acid" means any nucleic acid encoding DNM2. For example, in certain embodiments, a DNM2 nucleic acid includes a DNA chromosomal region encoding DNM2, an RNA transcribed from DNA encoding DNM2 (e.g., a pre-mRNA transcript), and an mRNA transcript encoding DNM2.

As used herein, "expression" includes all the functions by which a gene's coded information is converted into structures present and operating in a cell. Such structures include, but are not limited to, the products of transcription and translation. Methods for measuring expression levels (such as a transcription level or a translation level) are well-known in the field and include, but are not limited to, RT-PCR, RT-qPCR, Northern Blot, hybridization techniques such as, for example, use of microarrays, and combinations thereof including but not limited to, hybridization of amplicons obtained by RT-PCR, sequencing such as, for example, next-generation DNA sequencing (NGS) or RNA-seq (also known as "Whole Transcriptome Shotgun Sequencing") and the like, immunohistochemistry, Multiplex methods (Luminex), western blot, enzyme-linked immunosorbent assay (ELISA), sandwich ELISA, multiplex ELISA, electrochemiluminescence (ECL) (Elecsys®, Roche Diagnostics), enzyme-linked fluorescent assay (ELFA) (such as VIDAS®, Biomerieux), fluorescent-linked immunosorbent assay (FLISA), enzyme immunoassay (ETA), radioimmunoassay (RIA), flow cytometry (FACS), surface plasmon resonance (SPR), biolayer interferometry (BLI), immunochromatographic assay (ICA) (such as NEXUS IB10, Sphingotech) and mass spectrometry-based approaches.

As used herein, "gapmer" means an oligonucleotide, such as an antisense oligonucleotide, comprising an internal segment having a plurality of nucleosides that support RNase H cleavage positioned between external segments, each having one or more nucleosides, wherein the nucleosides comprising the internal segment are chemically distinct from the immediately adjacent nucleoside or nucleosides comprising the external segments. The internal segment may be referred to as the "gap" or "gap segment" and the external segments may be referred to as the "wings" or "wing segments".

As used herein, "hybridization" means the pairing or annealing of complementary oligonucleotides and/or nucleic acids. While not limited to a particular mechanism, the most common mechanism of hybridization involves hydrogen bonding, which may be, for example, Watson-Crick, Hoogsteen or reversed Hoogsteen hydrogen bonding, between complementary nucleobases.

As used herein, "individual" means a human or non-human animal selected for treatment or therapy.

As used herein, "inhibiting the expression or activity" refers to a reduction or blockade of the expression or activity relative to the expression or activity in an untreated or control sample and does not necessarily indicate a total elimination of expression or activity. In one embodiment, inhibiting the expression or activity refers to a reduction or blockade of the expression or activity relative to the expression or activity in an untreated or control sample of at least about 40%, at least about 50%, at least about 60%, at least about 70%, at least about 80%, or at least about 90%. In one embodiment, inhibiting the expression or activity refers to a reduction or blockade of the expression or activity relative to the expression or activity in an untreated or control sample of at least 50%, 55%, 60%, 65%, 70%, 75%, 80%, 85%, 90%, 91%, 92%, 93%, 94%, 95%, 96%, 97%, 98% or 99%.

As used herein, the term "about" preceding a figure means plus or less 10% of the value of said figure.

As used herein, the terms "internucleoside linkage" means a group or bond that forms a covalent linkage between adjacent nucleosides in an oligonucleotide. As used herein "modified internucleoside linkage" means any internucleoside linkage other than a naturally occurring, phosphate internucleoside linkage. Non-phosphate linkages are referred to herein as modified internucleoside linkages. "Phosphorothioate linkage" means a modified phosphate linkage in which one of the non-bridging oxygen atoms is replaced with a sulfur atom. A phosphorothioate internucleoside linkage is a modified internucleoside linkage. Modified internucleoside linkages include linkages that comprise abasic nucleosides. As used herein, "abasic nucleoside" means a sugar moiety in an oligonucleotide or oligomeric compound that is not directly connected to a nucleobase. In certain embodiments, an abasic nucleoside is adjacent to one or two nucleosides in an oligonucleotide.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar" or "non-bicyclic modified sugar moiety" means a modified sugar moiety that comprises a modification, such as a substituent, that does not form a bridge between two atoms of the sugar to form a second ring.

As used herein, "linked nucleosides" are nucleosides that are connected in a continuous sequence (i.e. no additional nucleosides are present between those that are linked).

As used herein, "mismatch" or "non-complementary" means a nucleobase of a first oligonucleotide that is not complementary with the corresponding nucleobase of a second oligonucleotide or target nucleic acid when the first and second oligomeric compound are aligned.

As used herein, "modulating" refers to changing or adjusting a feature in a cell, tissue, organ or organism. For example, modulating DNM2 expression can mean to increase or decrease the level of an DNM2 RNA and/or a DNM2 protein in a cell, tissue, organ or organism. A "modulator" effects the change in the cell, tissue, organ or organism. For example, a compound that modulates DNM2 expression can be a modulator that decreases the amount of a DNM2 RNA and/or a DNM2 protein in a cell, tissue, organ or organism.

As used herein, "MOE" means methoxyethyl. "2'-MOE" or "2'-O-methoxyethyl" means a 2'-OCH$_2$CH$_2$OCH$_3$ group in place of the 2'-OH group of a ribosyl ring.

As used herein, "motif" means the pattern of unmodified and/or modified sugar moieties, nucleobases, and/or internucleoside linkages, in an oligonucleotide.

As used herein, "naturally occurring" means found in nature.

As used herein, "nucleobase" means an unmodified nucleobase or a modified nucleobase. As used herein an "unmodified nucleobase" is adenine (A), thymine (T), cytosine (C), uracil (U), and guanine (G). As used herein, a modified nucleobase is a group of atoms capable of pairing with at least one unmodified nucleobase. A universal base is a nucleobase that can pair with any one of the five unmodified nucleobases.

As used herein, "nucleobase sequence" means the order of contiguous nucleobases in a nucleic acid or oligonucleotide independent of any sugar or internucleoside linkage modification.

As used herein, "nucleoside" means a moiety comprising a nucleobase and a sugar moiety. The nucleobase and sugar moiety are each, independently, unmodified or modified. As used herein, "modified nucleoside" means a nucleoside comprising a modified nucleobase and/or a modified sugar moiety.

As used herein, "oligomeric compound" means a compound consisting of an oligonucleotide and optionally one or more additional features, such as a conjugate group or terminal group.

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to an animal. Certain such carriers enable pharmaceutical compositions to be formulated as, for example, liquids, powders, or suspensions that can be aerosolized or otherwise dispersed for inhalation by a subject. In certain embodiments, a pharmaceutically acceptable carrier or diluent is sterile water; sterile saline; or sterile buffer solution. In one embodiment, the pharmaceutically acceptable carrier or diluent does not produce an adverse, allergic or other untoward reaction when administered to an animal, preferably a human. It includes any and all solvents, dispersion media, coatings, antibacterial and antifungal agents, isotonic and absorption delaying agents and the like. For human administration, preparations should meet sterility, pyrogenicity, general safety and purity standards as required by regulatory offices, such as, for example, FDA Office or EMA.

As used herein "pharmaceutically acceptable salts" means physiologically and pharmaceutically acceptable salts of compounds, such as oligomeric compounds, i.e., salts that retain the desired biological activity of the parent compound and do not impart undesired toxicological effects thereto.

As used herein "pharmaceutical composition" means a mixture of substances suitable for administering to a subject. For example, a pharmaceutical composition may comprise an antisense compound and an aqueous solution.

As used herein, "phosphorus moiety" means a group of atoms comprising a phosphorus atom. In certain embodiments, a phosphorus moiety comprises a mono-, di-, or tri-phosphate, or phosphorothioate.

As used herein "prodrug" means a therapeutic agent in a form outside the body that is converted to a different form within the body or cells thereof. Typically conversion of a prodrug within the body is facilitated by the action of an enzymes (e.g., endogenous or viral enzyme) or chemicals present in cells or tissues and/or by physiologic conditions.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense oligonucleotides that act through RNase H.

As used herein, the term "single-stranded" in reference to an antisense compound means such a compound consisting of one oligomeric compound that is not paired with a second oligomeric compound to form a duplex. "Self-complementary" in reference to an oligonucleotide means an oligonucleotide that at least partially hybridizes to itself. A compound consisting of one oligomeric compound, wherein the oligonucleotide of the oligomeric compound is self-complementary, is a single-stranded compound. A single-stranded antisense or oligomeric compound may be capable of binding to a complementary oligomeric compound to form a duplex, in which case the compound would no longer be single-stranded.

As used herein, "standard cell assay" means any of the assays described in Examples 1-9, and reasonable variations thereof.

As used herein, "standard in vivo experiment" means the procedure described in Example 10 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "sugar moiety" means an unmodified sugar moiety or a modified sugar moiety. As used herein, "unmodified sugar moiety" means a 2'-OH(H) ribosyl moiety, as found in RNA (an "unmodified RNA sugar moiety"), or a 2'-H(H) moiety, as found in DNA (an "unmodified DNA sugar moiety"). As used herein, "modified sugar moiety" or "modified sugar" means a modified furanosyl sugar moiety or a sugar surrogate. As used herein, modified furanosyl sugar moiety means a furanosyl sugar comprising a non-hydrogen substituent in place of at least one hydrogen of an unmodified sugar moiety. In certain embodiments, a modified furanosyl sugar moiety is a 2'-substituted sugar moiety. Such modified furanosyl sugar moieties include bicyclic sugars and non-bicyclic sugars. As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or nucleic acids.

As used herein, "target nucleic acid," "target RNA," "target RNA transcript" and "nucleic acid target" mean a nucleic acid that an antisense compound is designed to affect.

As used herein, "target region" means a portion of a target nucleic acid to which an antisense compound is designed to hybridize.

As used herein, "terminal group" means a chemical group or group of atoms that is covalently linked to a terminus of an oligonucleotide.

As used herein, "terminal wing nucleoside" means a nucleoside that is located at the terminus of a wing segment of a gapmer. Any wing segment that comprises or consists of at least two nucleosides has two termini: one that is immediately adjacent to the gap segment; and one that is at the end opposite the gap segment. Thus, any wing segment that comprises or consists of at least two nucleosides has two terminal nucleosides, one at each terminus.

As used herein, "therapeutically effective amount" means an amount of a compound, pharmaceutical agent, or composition that provides a therapeutic benefit to an individual. In certain embodiments, the therapeutically effective amount refers to the level or amount of a compound that treats or ameliorates symptoms of a disease associated with DNM2. In certain embodiments, the therapeutically effective amount may be administered prior to the onset of the disease associated with DNM2 or may be administered after initiation of the disease associated with DNM2.

As used herein, "treat" refers to administering a compound or pharmaceutical composition to an animal in order to effect an alteration or improvement of a disease, disorder, or condition in the animal. In one embodiment, a subject is successfully treated if, after receiving a therapeutically effective amount of a compound according to the present invention, the subject shows observable and/or measurable reduction or relief to some extent of one or more of the symptoms associated with the specific disease associated with DNM2, such as but not limited to reduced morbidity and mortality, improvement in quality of life issues, increased body weight, preservation or increase in muscle strength, decrease in time taken to rise from the floor, decrease in nine-meter walking time, decrease in time taken to climb four stairs, increased ability to lift weight, increased distance of a 6 minute walk, increased leg function grade, improved pulmonary function and/or cardiac function. Parameters for assessing successful treatment and improvement in the disease are readily measurable by routine procedures familiar to a physician.

Certain Embodiments

Certain embodiments provide methods, compounds and compositions for inhibiting DNM2 expression.

Certain embodiments provide methods, compounds and compositions for inhibiting DNM2 expression as compared to an untreated or control sample. In one embodiment, said inhibition is an inhibition of DNM2 expression of at least about 40%, at least about 50%, at least about 60%, at least about 70%, at least about 80%, or at least about 90%. In one embodiment, inhibiting the expression or activity refers to a reduction or blockade of the expression or activity relative to the expression or activity in an untreated or control sample of at least 50%, 55%, 60%, 65%, 70%, 75%, 80%, 85%, 90%, 91%, 92%, 93%, 94%, 95%, 96%, 97%, 98% or 99% as compared to an untreated or control sample.

Certain embodiments provide compounds comprising or consisting of oligonucleotides complementary to a DNM2 nucleic acid. In certain embodiments, the DNM2 nucleic acid has the sequence set forth in RefSeq or GenBank Accession No. NC_000019.10 truncated from nucleosides 10715001 to 10835000 (disclosed herein as SEQ ID NO: 1), NM_004945.3 (disclosed herein as SEQ ID NO: 2), NM_001005361.2 (disclosed herein as SEQ ID NO: 3), or NM_001005360.2 (disclosed herein as SEQ ID NO: 3135). In certain embodiments, the compound is an antisense compound or oligomeric compound. In certain embodiments, the compound is single-stranded. In certain embodiments, the compound is double-stranded.

Certain embodiments provide a compound comprising a modified oligonucleotide 8 to 50 linked nucleosides in length and having a nucleobase sequence comprising at least 8 contiguous nucleobases of any of the nucleobase sequences of SEQ ID NOs: 7-3134 or of any sequence having at least about 70% identity with any of the nucleobase sequences of SEQ ID NOs: 7-3134, such as, for example, at least about 75%, 80%, 85%, 90%, 91%, 92%, 93%, 94%, 95%, 96%, 97%, 98%, 99% identity or more with any of the nucleobase sequences of SEQ ID NOs: 7-3134.

As used herein, the term "identity" refers to the subunit sequence identity between two nucleic acid molecules, such as, two DNA molecules or two RNA molecules. When a subunit position in both of the two molecules is occupied by the same monomeric subunit; e.g., if a position in each of two DNA molecules is occupied by adenine, then they are identical (or homologous) at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous. Thus, the term "homologous" or "identical", when used in a relationship between the sequences of two or more nucleic acid molecules, refers to the degree of sequence relatedness between nucleic acid molecules, as determined by the number of matches between strings of two or more nucleotide residues. "Identity" measures the percent of identical matches between the smaller of two or more sequences with gap alignments (if any) addressed by a particular mathematical model or computer program (i.e., "algorithms"). Identity of related polypeptides can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988). Preferred methods for determining identity are designed to give the largest match between the sequences tested. Methods of determining identity are described in publicly available computer programs. Preferred computer program methods for determining identity between two sequences include the GCG program package, including GAP (Devereux et al., Nucl. Acid. Res. \2, 387 (1984); Genetics Computer Group, University of Wisconsin, Madison, Wis.), BLASTP, BLASTN, and FASTA (Altschul et al., J. Mol. Biol. 215, 403-410 (1990)). The BLASTX program is publicly available from the National Center for Biotechnology Information (NCBI) and other sources (BLAST Manual, Altschul et al. NCB/NLM/NIH Bethesda, Md. 20894; Altschul et al., supra). The well-known Smith Waterman algorithm may also be used to determine identity.

In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 8 to 50 linked nucleosides in length and having a nucleobase sequence comprising at least 8 contiguous nucleobases of any of the nucleobase sequences of SEQ ID NOs: 2879, 3056, 2123, 2189, 2453, 2160, or 2232 or at least 8 contiguous nucleobases of a sequence having at least 70% identity with any of the nucleobase sequences of SEQ ID NOs: 2879, 3056, 2123, 2189, 2453, 2160, or 2232. In certain embodiments, the nucleobase sequence of the modified oligonucleotide comprises or consists of SEQ ID NO: 2879 or a sequence having at least 70% identity with SEQ ID NO: 2879. In certain embodiments, the nucleobase sequence of the modified oligonucleotide comprises or consists of SEQ ID NO: 3056 or a sequence having at least 70% identity with SEQ ID NO: 3056. In certain embodiments, the nucleobase sequence of the modified oligonucleotide comprises or consists of SEQ ID NO: 2123 or a sequence having at least 70% identity with SEQ ID NO: 2123. In certain embodiments, the nucleobase sequence of the modified oligonucleotide comprises or consists of SEQ ID NO: 2189 or a sequence having at least 70% identity with SEQ ID NO: 2189. In certain embodiments, the nucleobase sequence of the modified oligonucleotide comprises or consists of SEQ ID NO: 2453 or a sequence having at least 70% identity with SEQ ID NO: 2453. In certain embodiments, the nucleobase sequence of the modified oligonucleotide comprises or consists of SEQ ID NO: 2160 or a sequence having at least 70% identity with SEQ ID NO: 2160. In certain embodiments, the nucleobase sequence of the modified oligonucleotide comprises or consists of SEQ ID NO: 2232 or a sequence having at least 70% identity with SEQ ID NO: 2232. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length. In certain embodiments, the modified oligonucleotide has a nucleobase sequence comprising at least 12 contiguous nucleobases of any of SEQ ID Numbers from 7 to 3134 or of any sequence having at least about 70% identity with any of the nucleobase sequences of SEQ ID NOs: 7-3134, such as, for example, at least about 75%, 80%, 85%, 90%, 91%, 92%, 93%, 94%, 95%, 96%, 97%, 98%, 99% identity or more with any of the nucleobase sequences of SEQ ID NOs: 7-3134.

Certain embodiments provide a compound comprising a modified oligonucleotide 10 to 50 linked nucleosides in length and having a nucleobase sequence comprising at least 10 contiguous nucleobases of any of the nucleobase sequences of SEQ ID NOs: 7-3134 or of any sequence having at least about 70% identity with any of the nucleobase sequences of SEQ ID NOs: 7-3134, such as, for example, at least about 75%, 80%, 85%, 90%, 91%, 92%, 93%, 94%, 95%, 96%, 97%, 98%, 99% identity or more with any of the nucleobase sequences of SEQ ID NOs: 7-3134. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 11 to 50 linked nucleosides in length and having a nucleobase sequence comprising at least 11 contiguous nucleobases of any of the nucleobase sequences of SEQ ID NOs: 7-3134 or of any sequence having at least about 70% identity with any of the nucleobase sequences of SEQ ID NOs: 7-3134, such as, for example, at least about 75%, 80%, 85%, 90%, 91%, 92%, 93%, 94%, 95%, 96%, 97%, 98%, 99% identity or more with any of the nucleobase sequences of SEQ ID NOs: 7-3134. In certain embodiments, the compound is an antisense compound or oligomeric compound. In certain embodiments, the compound is single-stranded. In certain embodiments, the compound is double-stranded. In certain embodiments, the modified oligonucleotide is 11 to 30 linked nucleosides in length.

Certain embodiments provide a compound comprising a modified oligonucleotide 12 to 50 linked nucleosides in length and having a nucleobase sequence comprising at least 12 contiguous nucleobases of any of the nucleobase sequences of SEQ ID NOs: 7-3134 or of any sequence having at least about 70% identity with any of the nucleobase sequences of SEQ ID NOs: 7-3134, such as, for example, at least about 75%, 80%, 85%, 90%, 91%, 92%, 93%, 94%, 95%, 96%, 97%, 98%, 99% identity or more with any of the nucleobase sequences of SEQ ID NOs: 7-3134. In certain embodiments, the compound is an antisense compound or oligomeric compound. In certain embodiments, the compound is single-stranded. In certain embodiments, the compound is double-stranded. In certain embodiments, the modified oligonucleotide is 12 to 30 linked nucleosides in length.

In certain embodiments, the compound comprises a modified oligonucleotide 16 linked nucleosides in length. In certain embodiments, the compound is an antisense compound or oligomeric compound.

Certain embodiments provide a compound comprising a modified oligonucleotide 16 to 50 linked nucleosides in length and having a nucleobase sequence comprising the nucleobase sequence of any one of SEQ ID NOs: 7-3134 or of any sequence having at least about 70% identity with any of the nucleobase sequences of SEQ ID NOs: 7-3134, such as, for example, at least about 75%, 80%, 85%, 90%, 91%, 92%, 93%, 94%, 95%, 96%, 97%, 98%, 99% identity or more with any of the nucleobase sequences of SEQ ID NOs: 7-3134. In certain embodiments, the compound is an antisense compound or oligomeric compound. In certain embodiments, the compound is single-stranded. In certain embodiments, the compound is double-stranded. In certain embodiments, the modified oligonucleotide is 16 to 30 linked nucleosides in length.

Certain embodiments provide a compound comprising a modified oligonucleotide consisting of the nucleobase sequence of any one of SEQ ID NOs: 7-3134 or of any sequence having at least about 70% identity with any of the nucleobase sequences of SEQ ID NOs: 7-3134, such as, for example, at least about 75%, 80%, 85%, 90%, 91%, 92%, 93%, 94%, 95%, 96%, 97%, 98%, 99% identity or more with any of the nucleobase sequences of SEQ ID NOs: 7-3134. In certain embodiments, the compound is an antisense compound or oligomeric compound. In certain embodiments, the compound is single-stranded. In certain embodiments, the compound is double-stranded.

In certain embodiments, compounds comprise or consist of modified oligonucleotides complementary to an intron of a DNM2 nucleic acid transcript. In certain embodiments, modified oligonucleotides are complementary to intron 1, intron 2, intron 3, intron 4, intron 5, intron 6, intron 7, intron 8, intron 9, intron 9-10a, intron 10, intron 10a-11, intron 11, intron 12, intron 13, intron 14, intron 15, intron 16, intron 17, intron 18, intron 19, or intron 19-20a of a DNM2 nucleic acid transcript. In certain such embodiments, modified oligonucleotides are complementary to a sequence within nucleotides 3404-44,737; 44,812-57,478; 57,629-60,702; 60,907-62,117; 62,217-67,959; 68,121-71,563; 71,707-78,719; 78,856-80,371; 80,440-81,060; 80,440-82,379; 81,200-83,485; 82,519-83,485; 83,573-87,287; 87,359-90,915; 90,968-97,263; 97,378-104,979; 105,090-108,787; 108,990-110,056; 110,222-114,035; 114,269-115,126; 115,379-115,977; or 115,379-115,980 of SEQ ID NO: 1. In certain embodiments, compounds comprise or consist of oligonucleotides having at least an 8, 9, 10, 11, 12, 13, 14, 15, or 16 contiguous nucleobase portion complementary to an equal length portion of intron 1, intron 2, intron 3, intron 4, intron 5, intron 6, intron 7, intron 8, intron 9, intron 9-10a, intron 10, intron 10a-11, intron 11, intron 12, intron 13, intron 14, intron 15, intron 16, intron 17, intron 18, intron 19, or intron 19-20a of a DNM2 nucleic acid transcript. In certain embodiments, such oligonucleotides have at least an 8, 9, 10, 11, 12, 13, 14, 15, or 16 contiguous nucleobase portion complementary to an equal length portion within nucleotides 3404-44,737; 44,812-57,478; 57,629-60,702; 60,907-62,117; 62,217-67,959; 68,121-71,563; 71,707-78,719; 78,856-80,371; 80,440-81,060; 80,440-82,379; 81,200-

83,485; 82,519-83,485; 83,573-87,287; 87,359-90,915; 90,968-97,263; 97,378-104,979; 105,090-108,787; 108,990-110,056; 110,222-114,035; 114,269-115,126; 115,379-115,977; or 115,379-115,980 of SEQ ID NO: 1. In certain embodiments, these compounds are antisense compounds or oligomeric compounds. Compounds comprising a modified oligonucleotide complementary to certain introns of a DNM2 nucleic acid transcript, e.g., intron 1, intron 11, intron 12, intron 13, or intron 14 of a DNM2 pre-mRNA, are generally especially potent and tolerable. Thus, such certain introns can be considered hot spot regions for targeting a DNM2 nucleic acid transcript.

In certain embodiments, compounds comprise or consist of modified oligonucleotides complementary to intron 1, intron 11, intron 12, intron 13, intron 14, exon 10, or the 3'-UTR of a DNM2 nucleic acid transcript. In certain embodiments, modified oligonucleotides are complementary to a sequence within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, compounds comprise or consist of oligonucleotides having at least an 8, 9, 10, 11, 12, 13, 14, 15, or 16 contiguous nucleobase portion complementary to an equal length portion of intron 1, intron 11, intron 12, intron 13, intron 14, exon 10, or the 3'-UTR of a DNM2 nucleic acid transcript. In certain embodiments, such oligonucleotides have at least an 8, 9, 10, 11, 12, 13, 14, 15, or 16 contiguous nucleobase portion complementary to an equal length portion within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, these compounds are antisense compounds or oligomeric compounds.

In certain embodiments, a compound comprises a modified oligonucleotide 8 to 50 linked nucleosides in length and having at least an 8, 9, 10, 11, 12, 13, 14, 15, or 16 contiguous nucleobase portion complementary to an equal length portion within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, the modified oligonucleotide is 10 to 30 linked nucleosides in length.

In certain embodiments, compounds comprise or consist of modified oligonucleotides complementary to intron 1, intron 11, intron 12, intron 13, or intron 14 of a DNM2 nucleic acid transcript. In certain embodiments, modified oligonucleotides are complementary to a sequence within nucleotides 3,404-44,737; 83,573-87,287; 87,359-90,915; 90,968-97,263; or 97,378-104,979 of SEQ ID NO: 1. In certain embodiments, compounds comprise or consist of oligonucleotides having at least an 8, 9, 10, 11, 12, 13, 14, 15, or 16 contiguous nucleobase portion complementary to an equal length portion of intron 1, intron 11, intron 12, intron 13, or intron 14 of a DNM2 nucleic acid transcript. In certain embodiments, such oligonucleotides have at least an 8, 9, 10, 11, 12, 13, 14, 15, or 16 contiguous nucleobase portion complementary to an equal length portion within nucleotides 3,404-44,737; 83,573-87,287; 87,359-90,915; 90,968-97,263; or 97,378-104,979 of SEQ ID NO: 1. In certain embodiments, these compounds are antisense compounds or oligomeric compounds.

In certain embodiments, a compound comprises a modified oligonucleotide 8 to 50 linked nucleosides in length and having at least an 8, 9, 10, 11, 12, 13, 14, 15, or 16 contiguous nucleobase portion complementary to an equal length portion within nucleotides 3,404-44,737; 83,573-87,287; 87,359-90,915; 90,968-97,263; or 97,378-104,979 of SEQ ID NO: 1. In certain embodiments, the modified oligonucleotide is 10 to 30 linked nucleosides in length.

In certain embodiments, a compound comprises a modified oligonucleotide 8 to 50 linked nucleosides in length and complementary within nucleotides 89,722-89,737; 83,880-83,895; 90,081-90,096; 94,450-94,465; 11,960-11,975; 93,322-93,337; or 97,855-97,870 of SEQ ID NO: 1. In certain embodiments, the modified oligonucleotide is 10 to 30 linked nucleosides in length.

In certain embodiments, a compound comprises a modified oligonucleotide 8 to 50 linked nucleosides in length and having a nucleobase sequence comprising at least an 8, 9, 10, 11, 12, 13, 14, 15, or 16 contiguous nucleobase portion of the nucleobase sequence of any one of compound numbers 951799, 949935, 950023, 950089, 951372, 950060, or 950132 (SEQ ID NOs: 2879, 3056, 2123, 2189, 2453, 2160, or 2232). In certain embodiments, the modified oligonucleotide is 10 to 30 linked nucleosides in length. In certain embodiments, the nucleobase sequence of the modified oligonucleotide comprises or consists of SEQ ID NO: 2879 or of a sequence having at least 70% identity with SEQ ID NO: 2879. In certain embodiments, the nucleobase sequence of the modified oligonucleotide comprises or consists of SEQ ID NO: 3056 or of a sequence having at least 70% identity with SEQ ID NO: 3056. In certain embodiments, the nucleobase sequence of the modified oligonucleotide comprises or consists of SEQ ID NO: 2123 or of a sequence having at least 70% identity with SEQ ID NO: 2123. In certain embodiments, the nucleobase sequence of the modified oligonucleotide comprises or consists of SEQ ID NO: 2189 or of a sequence having at least 70% identity with SEQ ID NO: 2189. In certain embodiments, the nucleobase sequence of the modified oligonucleotide comprises or consists of SEQ ID NO: 2453 or of a sequence having at least 70% identity with SEQ ID NO: 2453. In certain embodiments, the nucleobase sequence of the modified oligonucleotide comprises or consists of SEQ ID NO: 2160 or of a sequence having at least 70% identity with SEQ ID NO: 2160. In certain embodiments, the nucleobase sequence of the modified oligonucleotide comprises or consists of SEQ ID NO: 2232 or of a sequence having at least 70% identity with SEQ ID NO: 2232.

In certain embodiments, a compound comprises or consists of a modified oligonucleotide 8 to 50 linked nucleosides in length and having a nucleobase sequence comprising the nucleobase sequence of any one of compound numbers 951799, 949935, 950023, 950089, 951372, 950060, or 950132 (SEQ ID NOs: 2879, 3056, 2123, 2189, 2453, 2160, or 2232). In certain embodiments, the modified oligonucleotide is 10 to 30 linked nucleosides in length.

In certain embodiments, a compound comprises or consists of a modified oligonucleotide having a nucleobase sequence consisting of the nucleobase sequence of any one of compound numbers 951799, 949935, 950023, 950089, 951372, 950060, or 950132 (SEQ ID NOs: 2879, 3056, 2123, 2189, 2453, 2160, or 2232).

In certain embodiments, a compound comprises or consists of a modified oligonucleotide 8 to 50 linked nucleosides in length and having a nucleobase sequence comprising the nucleobase sequence of the compound number 951799 (SEQ ID NO: 2879). In certain embodiments, the modified oligonucleotide is 10 to 30 linked nucleosides in length.

In certain embodiments, a compound comprising or consisting of a modified oligonucleotide complementary to DNM2 is compound number 951799. Out of the over 3,000 compounds that were screened as described in the Examples section below, compound numbers 951799, 949935, 950023, 950089, 951372, 950060, and 950132 emerged as the top lead compounds. In particular, compound number 951799 exhibited the best combination of properties in terms of potency and tolerability out of over 3,000 compounds.

In certain embodiments, any of the foregoing oligonucleotides is a modified oligonucleotide comprising at least one modified internucleoside linkage, at least one modified sugar, and/or at least one modified nucleobase.

In certain embodiments, any of the foregoing modified oligonucleotides comprises at least one modified sugar. In certain embodiments, at least one modified sugar is a bicyclic sugar, such as a cEt bicyclic sugar, an LNA bicyclic sugar, or an ENA bicyclic sugar.

In certain embodiments, the modified oligonucleotide comprises at least one modified internucleoside linkage, such as a phosphorothioate internucleoside linkage.

In certain embodiments, any of the foregoing modified oligonucleotides comprises at least one modified nucleobase, such as 5-methylcytosine.

In certain embodiments, any of the foregoing modified oligonucleotides comprises:
a gap segment consisting of linked 2'-deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar. In certain embodiments, the modified oligonucleotide is 16 to 50 linked nucleosides in length having a nucleobase sequence comprising the sequence recited in any one of SEQ ID NOs: 2879, 3056, 2123, 2189, 2453, 2160, or 2232 or a sequence having at least 70% identity with any one of SEQ ID NOs: 2879, 3056, 2123, 2189, 2453, 2160, or 2232. In certain embodiments, the modified oligonucleotide is 16 to 50 linked nucleosides in length having a nucleobase sequence comprising the sequence recited in SEQ ID NO: 2879 or a sequence having at least 70% identity with SEQ ID NO: 2879. In certain embodiments, the modified oligonucleotide is 10 to 30 linked nucleosides in length having a nucleobase sequence comprising the sequence recited in any one of SEQ ID NOs: 2879, 3056, 2123, 2189, 2453, 2160, or 2232 or a sequence having at least 70% identity with any one of SEQ ID NOs: 2879, 3056, 2123, 2189, 2453, 2160, or 2232. In certain embodiments, the modified oligonucleotide is 10 to 30 linked nucleosides in length having a nucleobase sequence comprising the sequence recited in SEQ ID NO: 2879 or a sequence having at least 70% identity with SEQ ID NO: 2879. In certain embodiments, the modified oligonucleotide is 16 linked nucleosides in length having a nucleobase sequence consisting of the sequence recited in any one of SEQ ID NOs: 2879, 3056, 2123, 2189, 2453, 2160, or 2232 or a sequence having at least 70% identity with any one of SEQ ID NOs: 2879, 3056, 2123, 2189, 2453, 2160, or 2232. In certain embodiments, the modified oligonucleotide is 16 linked nucleosides in length having a nucleobase sequence consisting of the sequence recited in SEQ ID NO: 2879 or a sequence having at least 70% identity with SEQ ID NO: 2879.

In certain embodiments, a compound comprises or consists of a modified oligonucleotide 20-50 linked nucleobases in length having a nucleobase sequence comprising the sequence recited in any one of SEQ ID NOs: 2879, 3056, 2123, 2189, 2453, 2160, or 2232 or a sequence having at least 70% identity with any one of SEQ ID NOs: 2879, 3056, 2123, 2189, 2453, 2160, or 2232, wherein the modified oligonucleotide comprises a gap segment consisting of ten linked 2'-deoxynucleosides;

a 5' wing segment consisting of three linked nucleosides; and a 3' wing segment consisting of three linked nucleosides;

wherein the gap segment is positioned between the 5' wing segment and the 3' wing segment; wherein the nucleosides of the 5' wing segment each comprise a cEt bicyclic sugar; wherein the nucleosides of the 3' wing segment each comprises a cEt bicyclic sugar; wherein each internucleoside linkage is a phosphorothioate linkage; and wherein each cytosine is a 5-methylcytosine. In certain embodiments, the modified oligonucleotide is 16-80 linked nucleosides in length. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide according to one of the following formulas:

(SEQ ID NO: 2879)
Gks Tks Tks Tds Ads Tds Tds Ads Tds Ads Gds Gds

Gds mCks Tks Tk;

(SEQ ID NO: 3056)
Gks Gks Aks Tds Tds Tds Tds Ads Gds Gds Ads Gds

Gds Tks Gks Ak;

(SEQ ID NO: 2123)
Gks mCks Aks Tds Ads Gds Ads mCds Ads Ads Ads Tds mCds mCks mCks Ak;

(SEQ ID NO: 2189)
Gks mCks Aks Ads Ads Tds Ads Tds Gds Ads Tds Tds mCds Aks Tks mCk;

(SEQ ID NO: 2453)
Gks Gks Tks mCds Ads Tds Tds Ads Ads Ads Gds Ads

Tds Tks mCks Tk;

(SEQ ID NO: 2160)
Aks Tks Gks Tds Ads Tds Tds Ads mCds mCds Tds Ads mCds Gks Gks mCk;
or (SEQ ID NO: 2232)
Gks Tks Aks mCds Ads Ads Tds Gds Tds Ads Ads Gds mCds mCks Tks Tk wherein A=an adenine, mC=a 5-methylcytosine, G=a guanine, T=a thymine, k=a cEt sugar moiety, d=a 2'-deoxyribosyl sugar moiety, and s=a phosphorothioate internucleoside linkage.
In certain embodiments, a compound comprises or consists of compound 951799, or salt thereof, a modified oligonucleotide having the following chemical structure:
[SEQ ID NO: 2879]
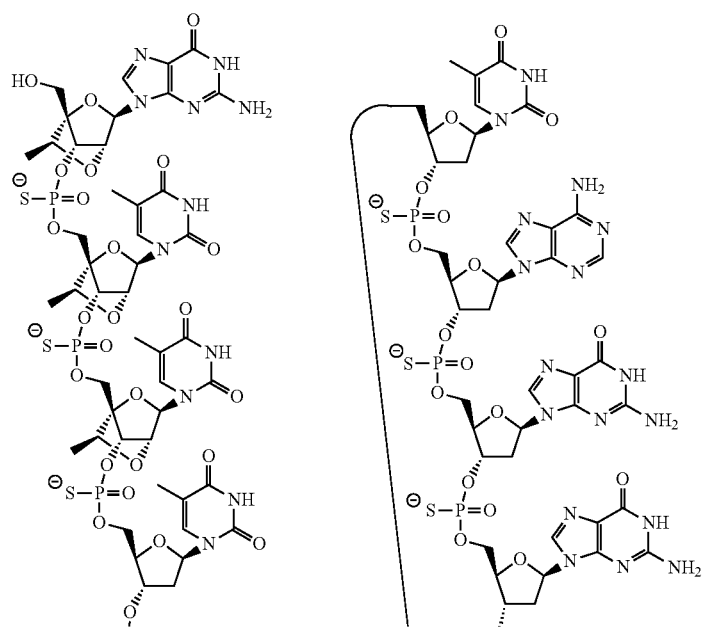
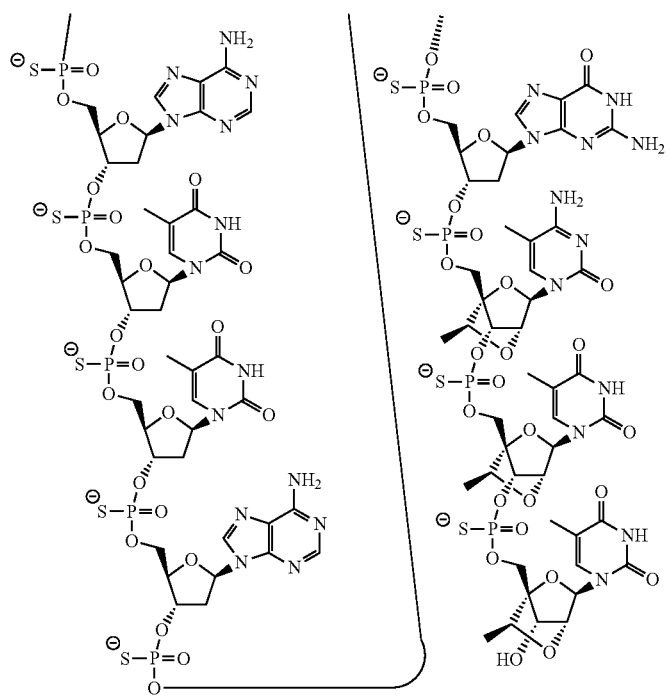

In certain embodiments, a compound comprises or consists of the sodium salt of compound 951799 having the following chemical structure:

[SEQ ID NO: 2879]

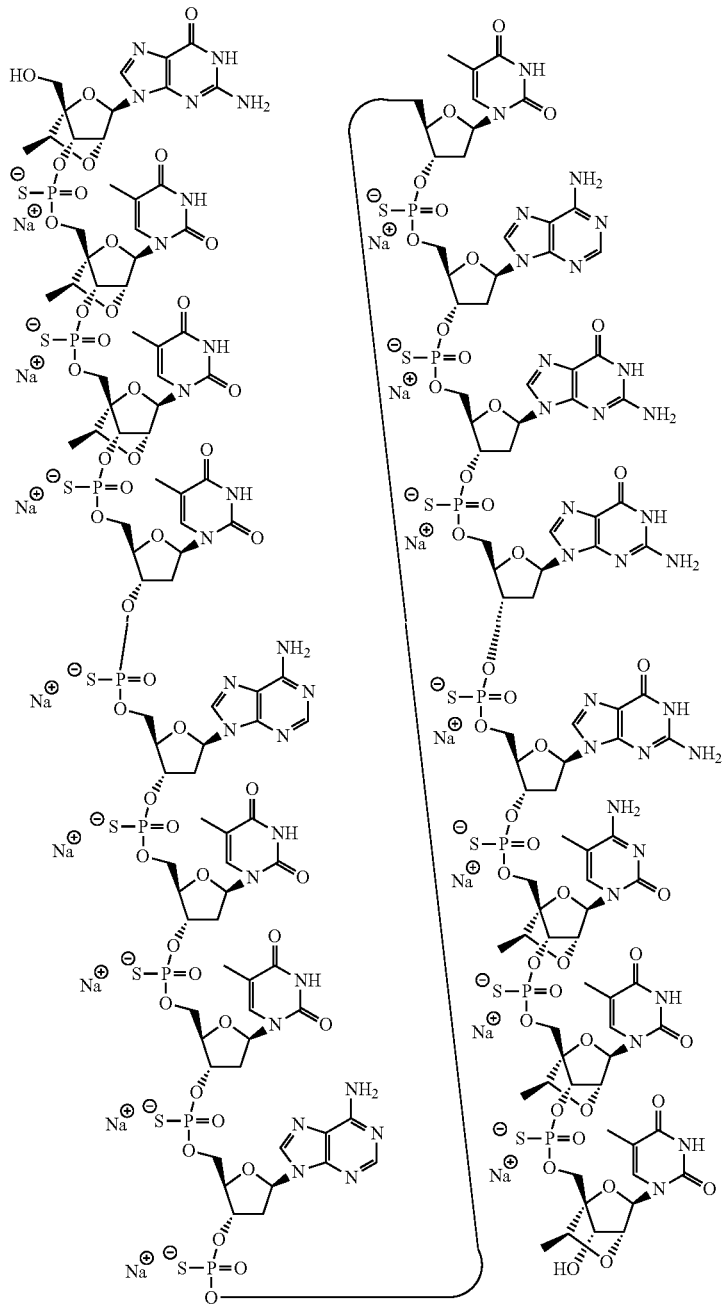

In any of the foregoing embodiments, the compound or oligonucleotide can be at least 85%, at least 90%, at least 95%, at least 98%, at least 99%, or 100% complementary to a nucleic acid encoding DNM2.

In any of the foregoing embodiments, the compound can be single-stranded. In certain embodiments, the compound comprises 2'-deoxyribonucleosides. In certain embodiments, the compound is double-stranded. In certain embodiments, the compound is double-stranded and comprises ribonucleosides. In any of the foregoing embodiments, the compound can be an antisense compound or oligomeric compound.

In any of the foregoing embodiments, the compound can be 8 to 80, 10 to 30, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked nucleosides in length. In certain embodiments, the compound comprises or consists of an oligonucleotide.

The present invention thus relates to a modified oligonucleotide or compounds comprising modified oligonucleotides complementary to a DNM2 nucleic acid as described hereinabove.

In certain embodiments, a compound comprises a modified oligonucleotide described herein and a conjugate group. In certain embodiments, the conjugate group is linked to the modified oligonucleotide at the 5' end of the modified oligonucleotide. In certain embodiments, the conjugate group is linked to the modified oligonucleotide at the 3' end of the modified oligonucleotide.

In certain embodiments, compounds or compositions provided herein comprise a salt of the modified oligonucleotide. In certain embodiments, the salt is a sodium salt. In certain embodiments, the salt is a potassium salt.

In certain embodiments, the compounds or compositions as described herein are active by virtue of having at least one of an in vitro $IC_{50}$ of less than 300 nM, 200 nM, 100 nM, 80 nM, 50 nM, or 30 nM in a standard cell assay. Standard cell assays are described in the Examples.

In certain embodiments, the compounds or compositions as described herein are highly tolerable as demonstrated by having at least one of an increase an alanine transaminase (ALT) or aspartate transaminase (AST) value of no more than 4 fold, 3 fold, 2 fold, or 1.5 fold over saline treated animals or an increase in liver, spleen, or kidney weight of no more than 30%, 20%, 15%, 12%, 10%, 5%, or 2% compared to control treated animals. In certain embodiments, the compounds or compositions as described herein are highly tolerable as demonstrated by having no increase of ALT or AST over control treated animals. In certain embodiments, the compounds or compositions as described herein are highly tolerable as demonstrated by having no increase in liver, spleen, or kidney weight over control animals.

Certain embodiments provide a composition comprising or consisting essentially of the compound of any of the aforementioned embodiments or salt thereof.

Certain embodiments provide a composition comprising or consisting essentially of the compound of any of the aforementioned embodiments or salt thereof and at least one of a pharmaceutically acceptable carrier or diluent. Therefore, in one embodiment, the composition of the invention is a pharmaceutical composition.

Certain embodiments provide a medicament comprising or consisting essentially of the compound of any of the aforementioned embodiments or salt thereof. Therefore, in one embodiment, the composition of the invention is a medicament.

As used herein, the term "consists essentially of", with reference to a composition, pharmaceutical composition or medicament, means that the compound of the invention is the only active ingredient, therapeutic agent or agent with a biologic activity within said pharmaceutical composition or medicament.

In certain embodiments, the composition has a viscosity less than about 40 centipoise (cP), less than about 30 cP, less than about 20 cP, less than about 15 cP, less than about 10 cP, less than about 5 cP, or less than about 3 cP, or less than about 1.5 cP. In certain embodiments, the composition having any of the aforementioned viscosities comprises a compound provided herein at a concentration of about 15 mg/mL, 20 mg/mL, 25 mg/mL, 50 mg/mL, 100 mg/mL, 150 mg/mL, or about 200 mg/mL. In certain embodiments, the composition having any of the aforementioned viscosities and/or compound concentrations has a temperature of room temperature or about 20° C., about 21° C., about 22° C., about 23° C., about 24° C., about 25° C., about 26° C., about 27° C., about 28° C., about 29° C., or about 30° C.

Embodiment 1

A compound comprising a modified oligonucleotide 8 to 50 linked nucleosides in length having a nucleobase sequence comprising at least 8 contiguous nucleobases of any of the nucleobase sequences of SEQ ID NOs: 7-3134.

Embodiment 2

A compound comprising a modified oligonucleotide 9 to 50 linked nucleosides in length having a nucleobase sequence comprising at least 9 contiguous nucleobases of any of the nucleobase sequences of SEQ ID NOs: 7-3134.

Embodiment 3

A compound comprising a modified oligonucleotide 10 to 50 linked nucleosides in length having a nucleobase sequence comprising at least 10 contiguous nucleobases of any of the nucleobase sequences of SEQ ID NOs: 7-3134.

Embodiment 4

A compound comprising a modified oligonucleotide 11 to 50 linked nucleosides in length having a nucleobase sequence comprising at least 11 contiguous nucleobases of any of the nucleobase sequences of SEQ ID NOs: 7-3134.

Embodiment 5

A compound comprising a modified oligonucleotide 12 to 50 linked nucleosides in length having a nucleobase sequence comprising at least 12, at least 13, at least 14, or at least 15 contiguous nucleobases of any of the nucleobase sequences of SEQ ID NOs: 7-3134.

Embodiment 6

A compound comprising a modified oligonucleotide 16 to 50 linked nucleosides in length having a nucleobase sequence comprising the nucleobase sequence of any of SEQ ID NOs: 7-3134.

Embodiment 7

A compound comprising a modified oligonucleotide having a nucleobase sequence consisting of any one of SEQ ID NOs: 7-3134.

Embodiment 8

A compound comprising a modified oligonucleotide 8 to 50 linked nucleosides in length complementary within nucleobases 3,404-44,737; 83,573-87,287; 87,359-90,915; 90,968-97,263; 97,378-104,979; 81,061-81,199; or 116,048-116,903 of SEQ ID NO: 1, wherein said modified oligonucleotide is at least 85%, 90%, 95%, or 100% complementary to SEQ ID NO: 1.

Embodiment 9

A compound comprising a modified oligonucleotide 8 to 50 linked nucleosides in length having a nucleobase sequence comprising a portion of at least 8 contiguous nucleobases 100% complementary to an equal length portion of nucleobases 3,404-44,737; 83,573-87,287; 87,359-90,915; 90,968-97,263; 97,378-104,979; 81,061-81,199; or 116,048-116,903 of SEQ ID NO: 1, wherein the nucleobase sequence of the modified oligonucleotide is at least 85%, 90%, 95%, or 100% complementary to SEQ ID NO: 1.

Embodiment 10

A compound comprising a modified oligonucleotide 8 to 50 linked nucleosides in length complementary within nucleobases 83,573-87,287 or 87,359-90,915 of SEQ ID NO: 1, wherein said modified oligonucleotide is at least 85%, 90%, 95%, or 100% complementary to SEQ ID NO: 1.

Embodiment 11

A compound comprising a modified oligonucleotide complementary to intron 1 of a human DNM2 pre-mRNA.

Embodiment 12

A compound comprising a modified oligonucleotide complementary to intron 11 of a human DNM2 pre-mRNA.

Embodiment 13

A compound comprising a modified oligonucleotide complementary to intron 12 of a human DNM2 pre-mRNA.

Embodiment 14

A compound comprising a modified oligonucleotide complementary to intron 13 of a human DNM2 pre-mRNA.

Embodiment 15

A compound comprising a modified oligonucleotide complementary to intron 14 of a human DNM2 pre-mRNA.

Embodiment 16

A compound comprising a modified oligonucleotide complementary to exon 10 of a human DNM2 pre-mRNA or human DNM2 mRNA.

Embodiment 17

A compound comprising a modified oligonucleotide complementary to the 3'-UTR of a human DNM2 pre-mRNA or human DNM2 mRNA.

Embodiment 18

A compound comprising a modified oligonucleotide 16 to 50 linked nucleosides in length having a nucleobase sequence comprising any of SEQ ID NOs: 2879, 3056, 2123, 2189, 2453, 2160, or 2232.

Embodiment 19

A compound comprising a modified oligonucleotide having a nucleobase sequence consisting of any one of SEQ ID NOs: 2879, 3056, 2123, 2189, 2453, 2160, or 2232.

Embodiment 20

A compound comprising a modified oligonucleotide having a nucleobase sequence comprising SEQ ID NO: 2879.

Embodiment 21

A compound comprising a modified oligonucleotide 16 to 50 linked nucleosides in length having a nucleobase sequence comprising any of SEQ ID NOs: 2879, 3056, 2123, 2189, 2453, 2160, or 2232, wherein the modified oligonucleotide comprises:
 a gap segment consisting of 8-12 linked 2'-deoxynucleosides;
 a 5' wing segment consisting of 1-7 linked nucleosides; and
 a 3' wing segment consisting of 1-7 linked nucleosides;
 wherein the gap segment is positioned between the 5' wing segment and the 3' wing segment and wherein each terminal wing nucleoside comprises a modified sugar.

Embodiment 22

A compound comprising a modified oligonucleotide 16 linked nucleosides in length having a nucleobase sequence consisting of the sequence recited in SEQ ID NO: 2879, 3056, 2123, 2189, 2453, 2160, or 2232, wherein the modified oligonucleotide comprises
 a gap segment consisting of 10 linked 2'-deoxynucleosides;
 a 5' wing segment consisting of 3 linked nucleosides; and
 a 3' wing segment consisting of 3 linked nucleosides;
 wherein the gap segment is positioned between the 5' wing segment and the 3' wing segment; wherein each nucleoside of each wing segment comprises a cEt sugar moiety; wherein each internucleoside linkage is a phosphorothioate linkage; and wherein each cytosine is a 5-methylcytosine.

Embodiment 23

The compound of any one of embodiments 1-22, wherein the oligonucleotide is at least 80%, 85%, 90%, 95% or 100% complementary to any of SEQ ID NO: 1, 2, 3, or 3135.

Embodiment 24

The compound of any one of embodiments 1-23, wherein the modified oligonucleotide comprises at least one modified internucleoside linkage.

Embodiment 25

The compound of embodiments 24, wherein the at least one modified internucleoside linkage is a phosphorothioate internucleoside linkage.

Embodiment 26

The compound of any one of embodiments 1-21 or 23-25, wherein the modified oligonucleotide comprises at least one bicyclic sugar.

Embodiment 27

The compound of Embodiments 26, wherein the at least one bicyclic sugar is selected from the group consisting of LNA, ENA, and cEt.

Embodiment 28

The compound of embodiment 27, wherein the at least one bicyclic sugar moiety is a cEt sugar moiety.

Embodiment 29

The compound of any one of embodiments 1-28, wherein the modified oligonucleotide comprises at least one 5-methylcytosine.

Embodiment 30

The compound of any one of embodiments 1-29, wherein the modified oligonucleotide comprises:
 a gap segment consisting of linked 2'-deoxynucleosides;
 a 5' wing segment consisting of linked nucleosides; and
 a 3' wing segment consisting of linked nucleosides;
 wherein the gap segment is positioned immediately adjacent to and between the 5' wing segment and the 3' wing segment and wherein each nucleoside of each wing segment comprises a modified sugar moiety.

Embodiment 31

The compound of any one of embodiments 1-30, wherein the compound is single-stranded.

Embodiment 32

The compound of any one of embodiments 1-30, wherein the compound is double-stranded.

Embodiment 33

The compound of any one of embodiments 1-32, wherein the compound comprises at least one unmodified ribosyl sugar moiety.

Embodiment 34

The compound of any one of embodiments 1-33, wherein the compound comprises at least one unmodified 2'-deoxyribosyl sugar moiety.

Embodiment 35

The compound of any one of embodiments 1-34, wherein the modified oligonucleotide consists of 10 to 30 linked nucleosides.

Embodiment 36

The compound of any one of embodiments 1-34, wherein the modified oligonucleotide consists of 12 to 30 linked nucleosides.

Embodiment 37

The compound of any one of embodiments 1-34, wherein the modified oligonucleotide consists of 15 to 30 linked nucleosides.

Embodiment 38

The compound of any one of embodiments 1-34, wherein the modified oligonucleotide consists of 16 to 20 linked nucleosides.

Embodiment 39

A compound comprising a modified oligonucleotide according to the following formula: Gks Tks Tks Tds Ads Tds Tds Ads Tds Ads Gds Gds Gds mCks Tks Tk; wherein,
 A=an adenine,
 mC=a 5-methylcytosine
 G=a guanine,
 T=a thymine,
 k=a cEt sugar moiety,
 d=a 2'-deoxyribosyl sugar moiety, and
 s=a phosphorothioate internucleoside linkage.

Embodiment 40

The compound of any one of embodiments 1-39 comprising a conjugate group.

Embodiment 41

The compound of embodiment 40, wherein the compound consists of the modified oligonucleotide and the conjugate group.

Embodiment 42
A compound according to the following formula:
[SEQ ID NO: 2879]
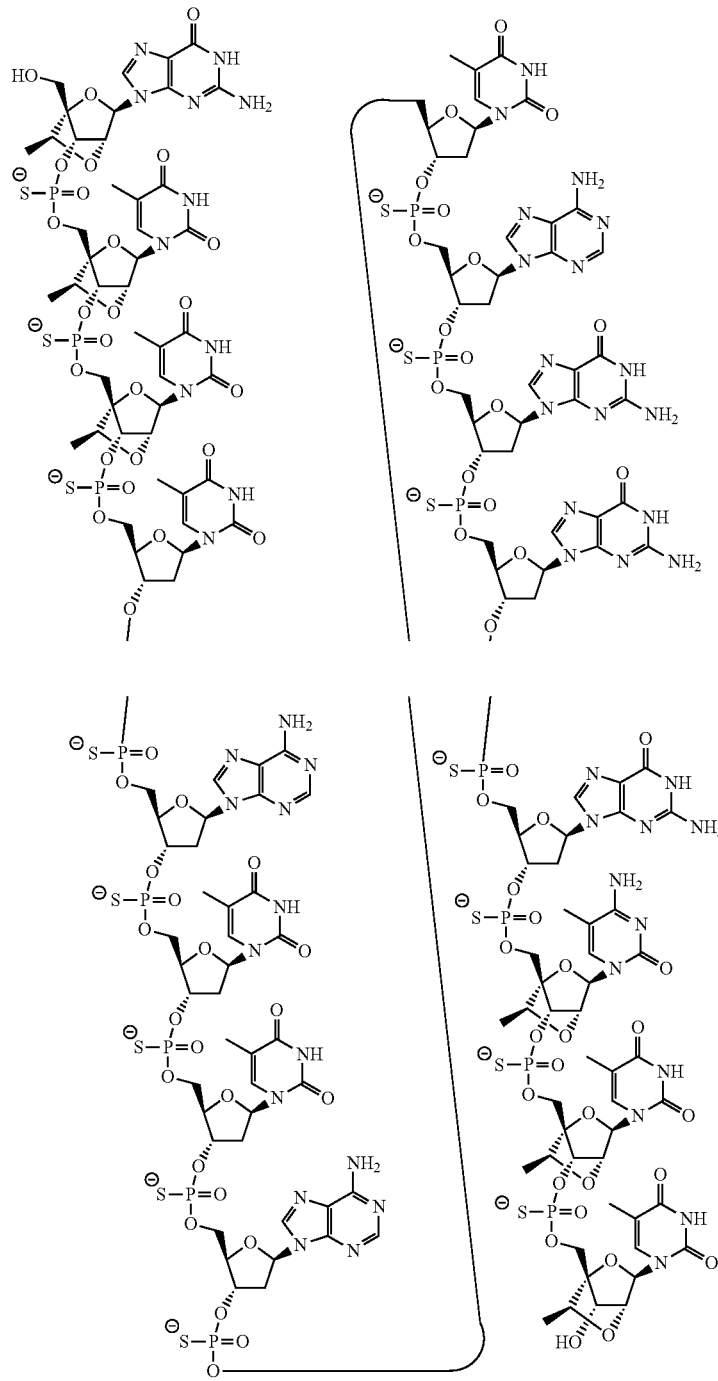
or a salt thereof.
Embodiment 43
The compound of any one of embodiments 1-39 or 42, wherein the compound consists of the modified oligonucleotide.

Embodiment 44

A compound consisting of a pharmaceutically acceptable salt form of any one of the compounds of embodiments 1-43.

Embodiment 45

The compound of embodiment 44, wherein the pharmaceutically acceptable salt is a sodium salt.

Embodiment 46

The compound of embodiment 44, wherein the pharmaceutically acceptable salt is a potassium salt.

Embodiment 47

A pharmaceutical composition comprising the compound of any one of embodiments 1-44 and at least one pharmaceutically acceptable carrier or diluent.

Embodiment 48

A chirally enriched population of the compounds of any one of embodiments 1-46, wherein the population is enriched for modified oligonucleotides comprising at least one particular phosphorothioate internucleoside linkage having a particular stereochemical configuration.

Embodiment 49

The chirally enriched population of embodiment 48, wherein the population is enriched for modified oligonucleotides comprising at least one particular phosphorothioate internucleoside linkage having the (Sp) configuration.

Embodiment 50

The chirally enriched population of embodiment 48, wherein the population is enriched for modified oligonucleotides comprising at least one particular phosphorothioate internucleoside linkage having the (Rp) configuration.

Embodiment 51

The chirally enriched population of embodiment 48, wherein the population is enriched for modified oligonucleotides having a particular, independently selected stereochemical configuration at each phosphorothioate internucleoside linkage

Embodiment 52

The chirally enriched population of embodiment 51, wherein the population is enriched for modified oligonucleotides having the (Sp) configuration at each phosphorothioate internucleoside linkage.

Embodiment 53

The chirally enriched population of embodiment 51, wherein the population is enriched for modified oligonucleotides having the (Rp) configuration at each phosphorothioate internucleoside linkage.

Embodiment 54

The chirally enriched population of embodiment 51, wherein the population is enriched for modified oligonucleotides having the (Rp) configuration at one particular phosphorothioate internucleoside linkage and the (Sp) configuration at each of the remaining phosphorothioate internucleoside linkages.

Embodiment 55

The chirally enriched population of embodiment 48 or embodiment 51, wherein the population is enriched for modified oligonucleotides having at least 3 contiguous phosphorothioate internucleoside linkages in the Sp, Sp, and Rp configurations, in the 5' to 3' direction.

Embodiment 56

A chirally enriched population of the compounds of any one of embodiments 1-46, wherein all of the phosphorothioate internucleoside linkages of the modified oligonucleotide are stereorandom.

Embodiment 57

A pharmaceutical composition comprising the population of compounds of any one of embodiments 48-56 and at least one pharmaceutically acceptable diluent or carrier.

Embodiment 58

The compound of any one of embodiments 1-46, a pharmaceutical composition comprising the compound of any one of embodiments 1-46 and at least one pharmaceutically acceptable carrier or diluent, or a pharmaceutical composition comprising the population of compounds of any one of embodiments 48-56 and at least one pharmaceutically acceptable carrier or diluent, for use in therapy.

Embodiment 59

The compound or composition of embodiment 58, for use in treating, preventing, or ameliorating centronuclear myopathy, Duchenne Muscular Dystrophy, or Charcot-Marie Tooth disease.

Embodiment 60

A method of treating, preventing, or ameliorating a disease associated with DNM2 in an individual comprising administering to the individual any of the compounds or compositions of embodiment 1-59, thereby treating, preventing, or ameliorating the disease.

Embodiment 61

A method of treating, preventing, or ameliorating a disease associated with DNM2 in an individual comprising administering to the individual a compound comprising a modified oligonucleotide 100% complementary to an exon 10, an intron, or the 3'-UTR of a DNM2 nucleic acid transcript, thereby treating, preventing, or ameliorating the disease.

Embodiment 62

The method of embodiment 60 or 61, wherein the disease is centronuclear myopathy, Duchenne Muscular Dystrophy, or Charcot-Marie Tooth disease.

Embodiment 63

The method of any one of embodiments 60-62, wherein the compound is single-stranded.

Embodiment 64

The method of any one of embodiments 60-63, wherein the DNM2 nucleic acid transcript is a pre-mRNA.

Embodiment 65

The method of any one of embodiments 60-64, wherein the disease is X-linked myotubular myopathy, autosomal recessive centronuclear myopathy, or autosomal dominant centronuclear myopathy.

Embodiment 66

The method of embodiment 65, wherein the individual has at least one mutation in at least one gene selected from among MTM1, BIN1, and DNM2.

Embodiment 67

The method of any one of embodiments 60-66, wherein the administering increases body weight or muscle strength.

Embodiment 68

A method of inhibiting expression of DNM2 in a cell comprising contacting the cell with a single-stranded compound comprising a modified oligonucleotide 100% complementary to exon 10, an intron, or the 3'-UTR of a DNM2 nucleic acid transcript, thereby inhibiting expression of DNM2 in the cell.

Embodiment 69

The method of embodiment 68, wherein the cell is in the muscle of an individual.

Embodiment 70

The method of embodiment 69, wherein the individual has, or is at risk of having, a centronuclear myopathy, Duchenne Muscular Dystrophy, or Charcot-Marie Tooth disease.

Embodiment 71

A method of increasing body weight or muscle strength in an individual having, or at risk of having, a disease associated with DNM2 comprising administering a single-stranded compound comprising a modified oligonucleotide 100% complementary to a DNM2 nucleic acid transcript to the individual, thereby increasing body weight or muscle strength in the individual.

Embodiment 72

The method of embodiment 71, wherein the individual has, or is at risk of having, centronuclear myopathy, Duchenne Muscular Dystrophy, or Charcot-Marie Tooth disease.

Embodiment 73

The method of any one of embodiments 60-72, wherein the compound is the compound of any one of embodiments 1-46.

Embodiment 74

The method of any one of embodiments 60-72, wherein the compound is a member of the chirally enriched population of any one of embodiments 48-56.

Embodiment 75

The method of any one of embodiments 60-72, wherein the compound is a component of the pharmaceutical composition of embodiment 57.

Embodiment 76

The method any one of embodiments 60-67 or 69-75, wherein the compound is administered to the individual via subcutaneous injection.

Embodiment 77

The method any one of embodiments 60-67 or 69-75, wherein the compound is administered to the individual via intramuscular injection.

Embodiment 78

The method of any one of embodiments 60-67 or 69-77, wherein the compound is administered to the individual via intravenous injection.

Embodiment 79

Use of a single-stranded compound comprising a modified oligonucleotide 100% complementary to exon 10, intron 1, intron 11, intron, 12, intron 13, intron 14, or the 3'-UTR of a DNM2 nucleic acid transcript for treating, preventing, or ameliorating a disease associated with DNM2.

Embodiment 80

The use of embodiment 79, wherein the disease is centronuclear myopathy, Duchenne Muscular Dystrophy, or Charcot-Marie Tooth disease.

Embodiment 81

Use of the compound of any one of embodiments 1-46 or the composition of embodiment 57 for treating, preventing, or ameliorating a disease associated with DNM2.

Embodiment 82

Use of the compound of any one of embodiments 1-46 or the composition of embodiment 57 in the manufacture of a medicament for treating, preventing, or ameliorating a disease associated with DNM2.

Embodiment 83

The use of embodiment 81 or 82, wherein the disease is centronuclear myopathy, Duchenne Muscular Dystrophy, or Charcot-Marie Tooth disease.

Embodiment 84

The use of embodiment 80 or 83, wherein the disease is X-linked myotubular myopathy, autosomal recessive centronuclear myopathy, or autosomal dominant centronuclear myopathy.

Embodiment 85

The use of embodiment 84, wherein the disease is associated with a mutation in at least one gene selected from among MTM1, BIN1, and DNM2.

Embodiment 86

Use of the compound of any one of embodiments 1-46 or the composition of embodiment 57 in the preparation of a medicament for treating, preventing, or ameliorating a disease associated with DNM2.

Embodiment 87

The use of embodiment 86, wherein the disease is centronuclear myopathy, Duchenne Muscular Dystrophy, or Charcot-Marie Tooth disease.

Embodiment 88

The use of embodiment 87, wherein the disease is X-linked myotubular myopathy, autosomal recessive centronuclear myopathy, or autosomal dominant centronuclear myopathy.

Embodiment 89

The use of embodiment 88, wherein the disease is associated with a mutation in at least one gene selected from among MTM1, BIN1, and DNM2.

Certain Indications

Certain embodiments provided herein relate to methods of inhibiting DNM2 expression, which can be useful for treating, preventing, or ameliorating a disease associated with DNM2 in an individual, by administration of a compound that targets DNM2, such as the compound described herein. In certain diseases associated with DNM2, modest or partial inhibition of DNM2 expression is sufficient to treat, prevent, or ameliorate the disease (See, e.g., Cowling et al. *J. Clin. Invest.* 124, 1350-1363 (2014) and Tasfaout et al. *Nat. Commun.* June 7; 8:15661 (2017).) In certain embodiments, the compound can be an antisense compound, oligomeric compound, or oligonucleotide complementary to DNM2, such as the ones described herein.

Examples of diseases associated with DNM2 that are treatable, preventable, and/or ameliorable with the methods provided herein include centronuclear myopathy (CNM), Charcot-Marie-Tooth disease (CMT), and Duchenne's Muscular Dystrophy (DMD). Centronuclear myopathy includes X-linked CNM (XLCNM), autosomal dominant CNM (ADCNM) and autosomal recessive CNM (ARCNM). Mutations in several genes are associated with CNM, including mutations in MTM1, BIN1, and DNM2. Other genes have been linked to a CNM-like myopathy: RYR1 encoding for the ryanodine receptor, TTN encoding Titin, CCDC78 (OMIM 614807) and the phosphoinositides phosphatase MTMR14 (called hJUMPY; OMIM 160150).

In certain embodiments, a method of treating, preventing, or ameliorating a disease associated with DNM2 in an individual comprises administering to the individual a compound comprising an antisense compound targeted to DNM2, thereby treating, preventing, or ameliorating the disease. In certain embodiments, the compound comprises an oligonucleotide complementary to a DNM2 nucleic acid transcript. In certain embodiments, the compound is a compound as described herein. In certain embodiments, the compound comprises or consists of a modified oligonucleotide complementary to intron 1, intron 11, intron 12, intron 13, intron 14, exon 10, or the 3'-UTR of a DNM2 nucleic acid transcript. In certain embodiments, the modified oligonucleotide is complementary to a sequence within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, the compound comprises or consists of a modified oligonucleotide complementary to intron 1, intron 11, intron 12, intron 13, or intron 14 of a DNM2 nucleic acid transcript. In certain embodiments, the modified oligonucleotide is complementary to a sequence within nucleotides 3,404-44,737; 83,573-87,287; 87,359-90,915; 90,968-97,263; or 97,378-104,979 of SEQ ID NO: 1. In certain embodiments, the compound comprises a modified oligonucleotide 8 to 50 linked nucleosides in length and having a nucleobase sequence comprising at least 8 contiguous nucleobases of any of the nucleobase sequences of SEQ ID NOs: 7-3134. In certain embodiments, the compound comprises a modified oligonucleotide 12 to 50 linked nucleosides in length and having a nucleobase sequence comprising the nucleobase sequence of any one of SEQ ID NOs: 7-3134. In certain embodiments, the compound comprises a modified oligonucleotide consisting of the nucleobase sequence of any one of SEQ ID NOs: 7-3134. In certain embodiments, the compound comprises a modified oligonucleotide 16 to 50 linked nucleosides in length having a nucleobase sequence comprising any one of SEQ ID NOs: 2879, 3056, 2123, 2189, 2453, 2160, or 2232. In certain embodiments, the compound comprises a modified oligonucleotide having a nucleobase sequence consisting of any one of SEQ ID NOs: 2879, 3056, 2123, 2189, 2453, 2160, or 2232. In any of the foregoing embodiments, the modified oligonucleotide can be 10 to 30 linked nucleosides in length. In certain embodiments, the compound is compound number 951799, 949935, 950023, 950089, 951372, 950060, or 950132. In any of the foregoing embodiments, the compound can be single-stranded or double-stranded. In any of the foregoing embodiments, the compound can be an antisense compound or oligomeric compound. In certain embodiments, the compound is administered to the individual subcutaneously, intradermally, intranodally, intramedullary, intramuscularly, intrasternally, by intravenous (i.v.) injection, by infusion techniques or intraperitoneally. In certain embodiments, the compound is administered to the individual via subcutaneous injection. In certain embodiments, administering the compound increases or preserves body weight or muscle strength.

In certain embodiments, a method of treating, preventing, or ameliorating CNM, DMD, or CMT comprises administering to the individual a compound comprising a modified oligonucleotide complementary to a DNM2 nucleic acid, thereby treating, preventing, or ameliorating CNM, DMD, or CMT. In certain embodiments, the compound is a compound as described herein. In certain embodiments, the compound is an antisense compound targeted to DNM2. In certain embodiments, the compound comprises or consists of a modified oligonucleotide complementary to intron 1, intron 11, intron 12, intron 13, intron 14, exon 10, or the 3'-UTR of a DNM2 nucleic acid transcript. In certain embodiments, the modified oligonucleotide is complementary to a sequence within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, the compound comprises or consists of a modified oligonucleotide complementary to intron 1, intron 11, intron 12, intron 13, or intron 14 of a DNM2 nucleic acid transcript. In certain embodiments, the modified oligonucleotide is complementary to a sequence within nucleotides 3,404-44,737; 83,573-87,287; 87,359-90,915; 90,968-97,263; or 97,378-104,979 of SEQ ID NO: 1. In certain embodiments, the compound comprises a modified oligonucleotide 8 to 50 linked nucleosides in length and having a nucleobase sequence comprising at least 8 contiguous nucleobases of any of the nucleobase sequences of SEQ ID NOs: 7-3134. In certain embodiments, the compound comprises a modified oligonucleotide 12 to 50 linked nucleosides in length and having a nucleobase sequence comprising the nucleobase sequence of any one of SEQ ID NOs: 7-3134. In certain embodiments, the compound comprises a modified oligonucleotide consisting of the nucleobase sequence of any one of SEQ ID NOs: 7-3134. In certain embodiments, the compound comprises a modified oligonucleotide 16 to 50 linked nucleosides in length having a nucleobase sequence comprising any one of SEQ ID NOs: 2879, 3056, 2123, 2189, 2453, 2160, or 2232. In certain embodiments, the compound comprises a modified oligonucleotide having a nucleobase sequence consisting of any one of SEQ ID NOs: 2879, 3056, 2123, 2189, 2453, 2160, or 2232. In any of the foregoing embodiments, the modified oligonucleotide can be 10 to 30 linked nucleosides in length. In certain embodiments, the compound is compound number 951799, 949935, 950023, 950089, 951372, 950060, or 950132. In any of the foregoing embodiments, the compound can be single-stranded or double-stranded. In any of the foregoing embodiments, the compound can be an antisense compound or oligomeric compound. In certain embodiments, the compound is administered to the individual subcutaneously, intradermally, intratumorally, intranodally, intramedullary, intramuscularly, intrasternally, by intravenous (i.v.) injection, by infusion techniques or intraperitoneally. In certain embodiments, the compound is administered to the individual systemically, e.g., via subcutaneous or intramuscular injection. In certain embodiments, administering the compound increases or preserves body weight or muscle strength. In certain such embodiments, time taken to rise from the floor, nine-meter walking time, or time taken to climb four stairs is decreased. In certain embodiments, ability to lift weight, distance of a 6 minute walk, or leg function grade is increased. In certain embodiments, pulmonary function or cardiac function is improved. In certain embodiments, the individual is identified as having or at risk of having a disease associated with DNM2. Examples of factors of risk of having a disease associated with DNM2 include, but are not limited to, genetic predisposition, such as, for example, a mutation in at least one gene selected from among MTM1, BIN1, and DNM2.

In certain embodiments, a method of inhibiting expression of DNM2 in an individual having, or at risk of having, a disease associated with DNM2 comprises administering to the individual a compound comprising a modified oligonucleotide complementary to a DNM2 nucleic acid, thereby inhibiting expression of DNM2 in the individual. In certain embodiments, administering the compound inhibits expression of DNM2 in skeletal muscle. In certain embodiments, the individual has, or is at risk of having CNM, DMD, or CMT. In certain embodiments, the compound comprises an antisense compound targeted to DNM2. In certain embodiments, the antisense compound comprises an oligonucleotide complementary to a DNM2 nucleic acid transcript. In certain embodiments, the compound is a compound as described herein. In certain embodiments, the compound comprises or consists of a modified oligonucleotide complementary to intron 1, intron 11, intron 12, intron 13, intron 14, exon 10, or the 3'-UTR of a DNM2 nucleic acid transcript. In certain embodiments, the modified oligonucleotide is complementary to a sequence within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, the compound comprises or consists of a modified oligonucleotide complementary to intron 1, intron 11, intron 12, intron 13, or intron 14 of a DNM2 nucleic acid transcript. In certain embodiments, the modified oligonucleotide is complementary to a sequence within nucleotides 3,404-44,737; 83,573-87,287; 87,359-90,915; 90,968-97,263; or 97,378-104,979 of SEQ ID NO: 1. In certain embodiments, the compound comprises a modified oligonucleotide 8 to 50 linked nucleosides in length and having a nucleobase sequence comprising at least 8 contiguous nucleobases of any of the nucleobase sequences of SEQ ID NOs: 7-3134. In certain embodiments, the compound comprises a modified oligonucleotide 12 to 50 linked nucleosides in length and having a nucleobase sequence comprising the nucleobase sequence of any one of SEQ ID NOs: 7-3134. In certain embodiments, the compound comprises a modified oligonucleotide consisting of the nucleobase sequence of any one of SEQ ID NOs: 7-3134. In certain embodiments, the compound comprises a modified oligonucleotide 16 to 50 linked nucleosides in length having a nucleobase sequence comprising any one of SEQ ID NOs: 2879, 3056, 2123, 2189, 2453, 2160, or 2232. In certain embodiments, the compound comprises a modified oligonucleotide having a nucleobase sequence consisting of any one of SEQ ID NOs: 2879, 3056, 2123, 2189, 2453, 2160, or 2232. In any of the foregoing embodiments, the modified oligonucleotide can be 10 to 30 linked nucleosides in length. In certain embodiments, the compound is compound number 951799, 949935, 950023, 950089, 951372, 950060, or 950132. In any of the foregoing embodiments, the compound can be single-stranded or double-stranded. In any of the foregoing embodiments, the compound can be an antisense compound or oligomeric compound. In certain embodiments, the compound is administered to the individual subcutaneously, intradermally, intranodally, intramedullary, intramuscularly, intrasternally, by intravenous (i.v.) injection, by infusion techniques or intraperitoneally. In certain embodiments, the compound is administered to the individual systemically, e.g., via subcutaneous or intramuscular injection. In certain embodiments, administering the compound increases or preserves body weight or muscle strength. In certain embodiments, the individual is identified as having or at risk of having a disease associated with DNM2.

In certain embodiments, a method of inhibiting expression of DNM2 in a cell comprises contacting the cell with a compound comprising an antisense compound targeted to DNM2, thereby inhibiting expression of DNM2 in the cell. In one embodiment, the expression of DNM2 is inhibited by at least about 40%, at least about 50%, at least about 60%, at least about 70%, at least about 80%, or at least about 90%. In one embodiment, the expression of DNM2 is inhibited by at least 50%, 55%, 60%, 65%, 70%, 75%, 80%, 85%, 90%, 91%, 92%, 93%, 94%, 95%, 96%, 97%, 98% or 99% as compared to an untreated or control sample. In one embodiment, the method is an in vitro method. In certain embodiments, the cell is a muscle cell. In certain embodiments, the cell is a skeletal muscle cell. In certain embodiments, the muscle cell is in an individual who has, or is at risk of having CNM, DMD, or CMT. In certain embodiments, the compound comprises an oligonucleotide complementary to a DNM2 nucleic acid transcript. In certain embodiments, the compound is a compound as described herein. In certain embodiments, the compound comprises or consists of a modified oligonucleotide complementary to intron 1, intron 11, intron 12, intron 13, intron 14, exon 10, or the 3'-UTR of a DNM2 nucleic acid transcript. In certain embodiments, the modified oligonucleotide is complementary to a sequence within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, the compound comprises or consists of a modified oligonucleotide complementary to intron 1, intron 11, intron 12, intron 13, or intron 14 of a DNM2 nucleic acid transcript. In certain embodiments, the modified oligonucleotide is complementary to a sequence within nucleotides 3,404-44,737; 83,573-87,287; 87,359-90,915; 90,968-97,263; or 97,378-104,979 of SEQ ID NO: 1. In certain embodiments, the compound comprises a modified oligonucleotide 8 to 50 linked nucleosides in length and having a nucleobase sequence comprising at least 8 contiguous nucleobases of any of the nucleobase sequences of SEQ ID NOs: 7-3134. In certain embodiments, the compound comprises a modified oligonucleotide 12 to 50 linked nucleosides in length and having a nucleobase sequence comprising the nucleobase sequence of any one of SEQ ID NOs: 7-3134. In certain embodiments, the compound comprises a modified oligonucleotide consisting of the nucleobase sequence of any one of SEQ ID NOs: 7-3134. In certain embodiments, the compound comprises a modified oligonucleotide 16 to 50 linked nucleosides in length having a nucleobase sequence comprising any one of SEQ ID NOs: 2879, 3056, 2123, 2189, 2453, 2160, or 2232. In certain embodiments, the compound comprises a modified oligonucleotide having a nucleobase sequence consisting of any one of SEQ ID NOs: 2879, 3056, 2123, 2189, 2453, 2160, or 2232. In any of the foregoing embodiments, the modified oligonucleotide can be 10 to 30 linked nucleosides in length. In certain embodiments, the compound is compound number 951799, 949935, 950023, 950089, 951372, 950060, or 950132. In any of the foregoing embodiments, the compound can be single-stranded or double-stranded. In any of the foregoing embodiments, the compound can be an antisense compound or oligomeric compound.

In certain embodiments, a method of increasing or preserving body weight or muscle strength of an individual having, or at risk of having, a disease associated with DNM2 comprises administering to the individual a compound comprising an antisense compound targeted to DNM2, increasing or preserving body weight or muscle strength of the individual. In certain such embodiments, time taken to rise from the floor, nine-meter walking time, or time taken to climb four stairs is decreased. In certain embodiments, ability to lift weight, distance of a 6 minute walk, or leg function grade is increased. In certain embodiments, pulmonary function or cardiac function is improved. In certain embodiments, the individual has, or is at risk of having, CNM, DMD, or CMT. In certain embodiments, the compound comprises an oligonucleotide complementary to a DNM2 nucleic acid transcript. In certain embodiments, the compound is a compound as described herein. In certain embodiments, the compound comprises or consists of a modified oligonucleotide complementary to intron 1, intron 11, intron 12, intron 13, intron 14, exon 10, or the 3'-UTR of a DNM2 nucleic acid transcript. In certain embodiments, the modified oligonucleotide is complementary to a sequence within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, the compound comprises or consists of a modified oligonucleotide complementary to intron 1, intron 11, intron 12, intron 13, or intron 14 of a DNM2 nucleic acid transcript. In certain embodiments, the modified oligonucleotide is complementary to a sequence within nucleotides 3,404-44,737; 83,573-87,287; 87,359-90,915; 90,968-97,263; or 97,378-104,979 of SEQ ID NO: 1. In certain embodiments, the compound comprises a modified oligonucleotide 8 to 50 linked nucleosides in length and having a nucleobase sequence comprising at least 8 contiguous nucleobases of any of the nucleobase sequences of SEQ ID NOs: 7-3134. In certain embodiments, the compound comprises a modified oligonucleotide 12 to 50 linked nucleosides in length and having a nucleobase sequence comprising the nucleobase sequence of any one of SEQ ID NOs: 7-3134. In certain embodiments, the compound comprises a modified oligonucleotide consisting of the nucleobase sequence of any one of SEQ ID NOs: 7-3134. In certain embodiments, the compound comprises a modified oligonucleotide 16 to 50 linked nucleosides in length having a nucleobase sequence comprising any one of SEQ ID NOs: 2879, 3056, 2123, 2189, 2453, 2160, or 2232. In certain embodiments, the compound comprises a modified oligonucleotide having a nucleobase sequence consisting of any one of SEQ ID NOs: 2879, 3056, 2123, 2189, 2453, 2160, or 2232. In any of the foregoing embodiments, the modified oligonucleotide can be 10 to 30 linked nucleosides in length. In certain embodiments, the compound is compound number 951799, 949935, 950023, 950089, 951372, 950060, or 950132. In any of the foregoing embodiments, the compound can be single-stranded or double-stranded. In any of the foregoing embodiments, the compound can be an antisense compound or oligomeric compound. In certain embodiments, the compound is administered to the individual subcutaneously, intradermally, intranodally, intramedullary, intramuscularly, intrasternally, by intravenous (i.v.) injection, by infusion techniques or intraperitoneally. In certain embodiments, the compound is administered to the individual systemically, e.g., via subcutaneous or intramuscular injection. In certain embodiments, the individual is identified as having or at risk of having a disease associated with DNM2.

Certain embodiments are drawn to a compound comprising an antisense compound targeted to DNM2 for use in treating a disease associated with DNM2. In certain embodiments, the disease is CNM, DMD, or CMT. In certain embodiments, the compound comprises an oligonucleotide complementary to a DNM2 nucleic acid transcript. In certain embodiments, the compound is a compound as described herein. In certain embodiments, the compound comprises or consists of a modified oligonucleotide complementary to intron 1, intron 11, intron 12, intron 13, intron 14, exon 10, or the 3'-UTR of a DNM2 nucleic acid transcript. In certain embodiments, the modified oligonucleotide is complementary to a sequence within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, the compound comprises or consists of a modified oligonucleotide complementary to intron 1, intron 11, intron 12, intron 13, or intron 14 of a DNM2 nucleic acid transcript. In certain embodiments, the modified oligonucleotide is complementary to a sequence within nucleotides 3,404-44,737; 83,573-87,287; 87,359-90,915; 90,968-97,263; or 97,378-104,979 of SEQ ID NO: 1. In certain embodiments, the compound comprises a modified oligonucleotide 8 to 50 linked nucleosides in length and having a nucleobase sequence comprising at least 8 contiguous nucleobases of any of the nucleobase sequences of SEQ ID NOs: 7-3134. In certain embodiments, the compound comprises a modified oligonucleotide 12 to 50 linked nucleosides in length and having a nucleobase sequence comprising the nucleobase sequence of any one of SEQ ID NOs: 7-3134. In certain embodiments, the compound comprises a modified oligonucleotide consisting of the nucleobase sequence of any one of SEQ ID NOs: 7-3134. In certain embodiments, the compound comprises a modified oligonucleotide 16 to 50 linked nucleosides in length having a nucleobase sequence comprising any one of SEQ ID NOs: 2879, 3056, 2123, 2189, 2453, 2160, or 2232. In certain embodiments, the compound comprises a modified oligonucleotide having a nucleobase sequence consisting of any one of SEQ ID NOs: 2879, 3056, 2123, 2189, 2453, 2160, or 2232. In any of the foregoing embodiments, the modified oligonucleotide can be 10 to 30 linked nucleosides in length. In certain embodiments, the compound is compound number 951799, 949935, 950023, 950089, 951372, 950060, or 950132. In any of the foregoing embodiments, the compound can be single-stranded or double-stranded. In any of the foregoing embodiments, the compound can be an antisense compound or oligomeric compound. In certain embodiments, the compound is administered to the individual subcutaneously, intradermally, intranodally, intramedullary, intramuscularly, intrasternally, by intravenous (i.v.) injection, by infusion techniques or intraperitoneally. In certain embodiments, the compound is to be administered to the individual systemically, e.g., via subcutaneous or intramuscular injection.

Certain embodiments are drawn to a compound comprising an antisense compound targeted to DNM2 for use in increasing or preserving body weight or muscle strength of an individual having or at risk of having CNM, DMD, or CMT. In certain embodiments, the compound comprises an oligonucleotide complementary to a DNM2 nucleic acid transcript. In certain embodiments, the compound is a compound as described herein. In certain embodiments, the compound comprises or consists of a modified oligonucleotide complementary to intron 1, intron 11, intron 12, intron 13, intron 14, exon 10, or the 3'-UTR of a DNM2 nucleic acid transcript. In certain embodiments, the modified oligonucleotide is complementary to a sequence within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, the compound comprises or consists of a modified oligonucleotide complementary to intron 1, intron 11, intron 12, intron 13, or intron 14 of a DNM2 nucleic acid transcript. In certain embodiments, the modified oligonucleotide is complementary to a sequence within nucleotides 3,404-44,737; 83,573-87,287; 87,359-90,915; 90,968-97,263; or 97,378-104,979 of SEQ ID NO: 1. In certain embodiments, the compound comprises a modified oligonucleotide 8 to 50 linked nucleosides in length and having a nucleobase sequence comprising at least 8 contiguous nucleobases of any of the nucleobase sequences of SEQ ID NOs: 7-3134. In certain embodiments, the compound comprises a modified oligonucleotide 12 to 50 linked nucleosides in length and having a nucleobase sequence comprising the nucleobase sequence of any one of SEQ ID NOs: 7-3134. In certain embodiments, the compound comprises a modified oligonucleotide consisting of the nucleobase sequence of any one of SEQ ID NOs: 7-3134. In certain embodiments, the compound comprises a modified oligonucleotide 16 to 50 linked nucleosides in length having a nucleobase sequence comprising any one of SEQ ID NOs: 2879, 3056, 2123, 2189, 2453, 2160, or 2232. In certain embodiments, the compound comprises a modified oligonucleotide having a nucleobase sequence consisting of any one of SEQ ID NOs: 2879, 3056, 2123, 2189, 2453, 2160, or 2232. In any of the foregoing embodiments, the modified oligonucleotide can be 10 to 30 linked nucleosides in length. In certain embodiments, the compound is compound number 951799, 949935, 950023, 950089, 951372, 950060, or 950132. In any of the foregoing embodiments, the compound can be single-stranded or double-stranded. In any of the foregoing embodiments, the compound can be an antisense compound or oligomeric compound.

Certain embodiments are drawn to use of the compound comprising an antisense compound targeted to DNM2 for the manufacture or preparation of a medicament for treating a disease associated with DNM2. Certain embodiments are drawn to use of the compound comprising an antisense compound targeted to DNM2 for the preparation of a medicament for treating a disease associated with DNM2. In certain embodiments, the disease is CNM, DMD, or CMT. In certain embodiments, the compound comprises an oligonucleotide complementary to a DNM2 nucleic acid transcript. In certain embodiments, the compound is a compound as described herein. In certain embodiments, the compound comprises or consists of a modified oligonucleotide complementary to intron 1, intron 11, intron 12, intron 13, intron 14, exon 10, or the 3'-UTR of a DNM2 nucleic acid transcript. In certain embodiments, the modified oligonucleotide is complementary to a sequence within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, the compound comprises or consists of a modified oligonucleotide complementary to intron 1, intron 11, intron 12, intron 13, or intron 14 of a DNM2 nucleic acid transcript. In certain embodiments, the modified oligonucleotide is complementary to a sequence within nucleotides 3,404-44,737; 83,573-87,287; 87,359-90,915; 90,968-97,263; or 97,378-104,979 of SEQ ID NO: 1. In certain embodiments, the compound comprises a modified oligonucleotide 8 to 50 linked nucleosides in length and having a nucleobase sequence comprising at least 8 contiguous nucleobases of any of the nucleobase sequences of SEQ ID NOs: 7-3134. In certain embodiments, the compound comprises a modified oligonucleotide 12 to 50 linked nucleosides in length and having a nucleobase sequence comprising the nucleobase sequence of any one of SEQ ID NOs: 7-3134. In certain embodiments, the compound comprises a modified oligonucleotide consisting of the nucleobase sequence of any one of SEQ ID NOs: 7-3134. In certain embodiments, the compound comprises a modified oligonucleotide 16 to 50 linked nucleosides in length having a nucleobase sequence comprising any one of SEQ ID NOs: 2879, 3056, 2123, 2189, 2453, 2160, or 2232. In certain embodiments, the compound comprises a modified oligonucleotide having a nucleobase sequence consisting of any one of SEQ ID NOs: 2879, 3056, 2123, 2189, 2453, 2160, or 2232. In any of the foregoing embodiments, the modified oligonucleotide can be 10 to 30 linked nucleosides in length. In certain embodiments, the compound is compound number 951799, 949935, 950023, 950089, 951372, 950060, or 950132. In any of the foregoing embodiments, the compound can be single-stranded or double-stranded. In any of the foregoing embodiments, the compound can be an antisense compound or oligomeric compound.

Certain embodiments are drawn to use of a compound comprising an antisense compound targeted to DNM2 for the manufacture or preparation of a medicament for increasing or preserving body weight or muscle strength of an individual having or at risk of having CNM, DMD, or CMT. In certain embodiments, the compound comprises an oligonucleotide complementary to a DNM2 nucleic acid transcript. In certain embodiments, the compound is a compound as described herein. In certain embodiments, the compound comprises or consists of a modified oligonucleotide complementary to intron 1, intron 11, intron 12, intron 13, intron 14, exon 10, or the 3'-UTR of a DNM2 nucleic acid transcript. In certain embodiments, the modified oligonucleotide is complementary to a sequence within nucleotides 3,404-44,737; 83,573-87,287; 87,359-90,915; 90,968-97,263; 97,378-104,979; 81,061-81,199; or 116,048-116,903 of SEQ ID NO: 1. In certain embodiments, the compound comprises or consists of a modified oligonucleotide complementary to intron 1, intron 11, intron 12, intron 13, or intron 14 of a DNM2 nucleic acid transcript. In certain embodiments, the modified oligonucleotide is complementary to a sequence within nucleotides 3,404-44,737; 83,573-87,287; 87,359-90,915; 90,968-97,263; or 97,378-104,979 of SEQ ID NO: 1. In certain embodiments, the compound comprises a modified oligonucleotide 8 to 50 linked nucleosides in length and having a nucleobase sequence comprising at least 8 contiguous nucleobases of any of the nucleobase sequences of SEQ ID NOs: 7-3134. In certain embodiments, the compound comprises a modified oligonucleotide 12 to 50 linked nucleosides in length and having a nucleobase sequence comprising the nucleobase sequence of any one of SEQ ID NOs: 7-3134. In certain embodiments, the compound comprises a modified oligonucleotide consisting of the nucleobase sequence of any one of SEQ ID NOs: 7-3134. In certain embodiments, the compound comprises a modified oligonucleotide 16 to 50 linked nucleosides in length having a nucleobase sequence comprising any one of SEQ ID NOs: 2879, 3056, 2123, 2189, 2453, 2160, or 2232. In certain embodiments, the compound comprises a modified oligonucleotide having a nucleobase sequence consisting of any one of SEQ ID NOs: 2879, 3056, 2123, 2189, 2453, 2160, or 2232. In any of the foregoing embodiments, the modified oligonucleotide can be 10 to 30 linked nucleosides in length. In certain embodiments, the compound is compound number 951799, 949935, 950023, 950089, 951372, 950060, or 950132. In any of the foregoing embodiments, the compound can be single-stranded or double-stranded. In any of the foregoing embodiments, the compound can be an antisense compound or oligomeric compound.

In any of the foregoing methods or uses, the compound can be targeted to a DNM2 nucleic acid transcript. In certain embodiments, the compound comprises or consists of a modified oligonucleotide, for example a modified oligonucleotide 8 to 50 linked nucleosides in length, 10 to 30 linked nucleosides in length, 12 to 30 linked nucleosides in length, or 20 linked nucleosides in length. In certain embodiments, the modified oligonucleotide is at least 80%, 85%, 90%, 95% or 100% complementary to any of the nucleobase sequences recited in SEQ ID NOs: 1, 2, 3, or 3135. In certain embodiments, the modified oligonucleotide comprises at least one modified internucleoside linkage, at least one modified sugar, and at least one modified nucleobase. In certain such embodiments, the at least one modified internucleoside linkage is a phosphorothioate internucleoside linkage, the at least one modified sugar is a bicyclic sugar, and the at least one modified nucleobase is a 5-methylcytosine. In certain embodiments, the modified oligonucleotide comprises a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each terminal wing nucleoside comprises a modified sugar.

In any of the foregoing embodiments, the modified oligonucleotide may be 12 to 30, 15 to 30, 15 to 25, 15 to 24, 16 to 24, 17 to 24, 18 to 24, 19 to 24, 20 to 24, 19 to 22, 20 to 22, 16 to 20, or 17 or 20 linked nucleosides in length. In certain embodiments, the modified oligonucleotide is at least 80%, 85%, 90%, 95% or 100% complementary to any of the nucleobase sequences recited in SEQ ID NOs: 1, 2, 3, or 3135. In certain embodiments, the modified oligonucleotide comprises at least one modified internucleoside linkage, at least one modified sugar, and at least one modified nucleobase. In certain embodiments, the at least one modified internucleoside linkage is a phosphorothioate internucleoside linkage, the at least one modified sugar is a bicyclic sugar, and the at least one modified nucleobase is a 5-methylcytosine. In certain embodiments, the modified oligonucleotide comprises a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each terminal wing nucleoside comprises a modified sugar.

In any of the foregoing methods or uses, the compound may comprise or consist of a modified oligonucleotide 16 to 30 linked nucleosides in length and having a nucleobase sequence comprising any one of SEQ ID NOs: 2879, 3056, 2123, 2189, 2453, 2160, or 2232, wherein the modified oligonucleotide comprises:

a gap segment consisting of linked 2'-deoxynucleosides;
a 5' wing segment consisting of linked nucleosides; and
a 3' wing segment consisting of linked nucleosides;

wherein the gap segment is positioned between the 5' wing segment and the 3' wing segment and wherein each nucleoside of each wing segment comprises a modified sugar.

In any of the foregoing methods or uses, the compound may comprise or consist of a modified oligonucleotide 16 to 30 linked nucleosides in length and having a nucleobase sequence comprising any one of SEQ ID NOs: 2879, 3056, 2123, 2189, 2453, 2160, or 2232, wherein the modified oligonucleotide comprises:

a gap segment consisting of linked 2'-deoxynucleosides;
a 5' wing segment consisting of linked nucleosides; and
a 3' wing segment consisting of linked nucleosides;

wherein the gap segment is positioned between the 5' wing segment and the 3' wing segment, wherein each terminal wing nucleoside comprises a modified sugar.

49

In any of the foregoing methods or uses, the compound may comprise or consist of a modified oligonucleotide 16 to 50 linked nucleobases in length having a nucleobase sequence comprising or consisting of the sequence recited in any one of SEQ ID NOs: 2879, 3056, 2123, 2189, 2453, 2160, or 2232, wherein the modified oligonucleotide comprises:
  a gap segment consisting of 10 linked 2'-deoxynucleosides;
  a 5' wing segment consisting of 3 linked nucleosides; and
  a 3' wing segment consisting of 3 linked nucleosides;

50 wherein the gap segment is positioned between the 5' wing segment and the 3' wing segment, wherein each nucleoside of each wing segment comprises a cEt sugar; wherein each internucleoside linkage is a phosphorothioate linkage and wherein each cytosine is a 5-methylcytosine. In certain embodiments, the modified oligonucleotide consists of 16-30 linked nucleosides. In certain embodiments, the modified oligonucleotide consists of 16 linked nucleosides.

In one embodiment, in any of the foregoing methods or uses, the compound has the following chemical structure:

[SEQ ID NO: 2879]

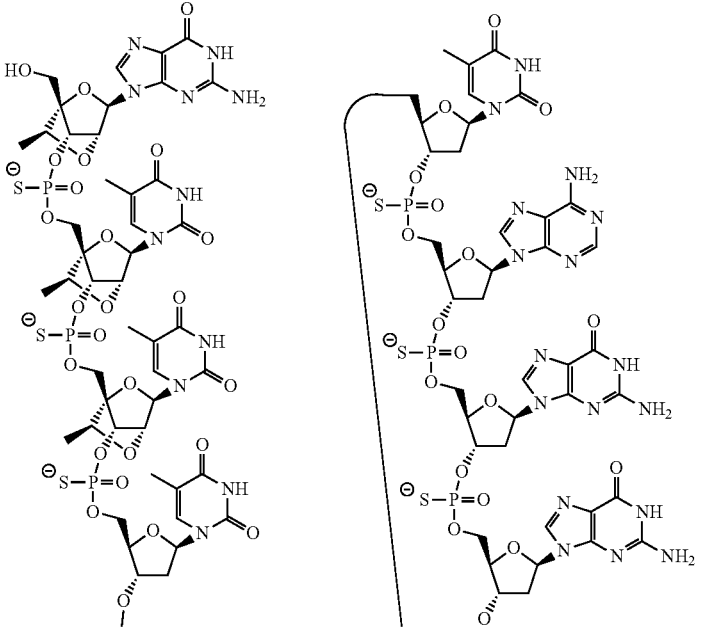

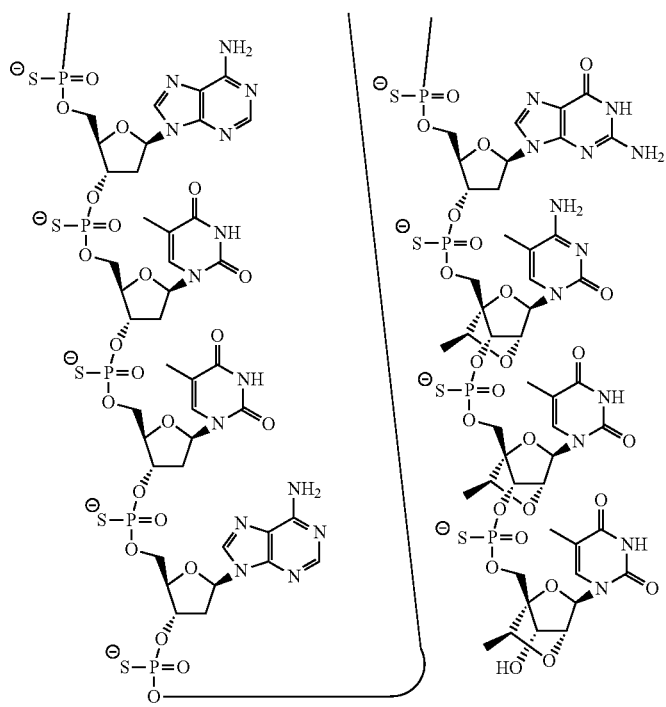

In one embodiment, in any of the foregoing methods or uses, the compound can be administered systemically. In certain embodiments, the compound of any of the foregoing methods or uses can be administered through injection or infusion. In certain embodiments, the compound of any of the foregoing methods or uses can be administered via subcutaneous administration, intravenous administration, intramuscular administration, intraarterial administration, intraperitoneal administration, or intracranial administration, e.g. intrathecal or intracerebroventricular administration. In certain embodiments, the compound is administered to the individual intradermally, intranodally, intramedullary or intrasternally. In certain embodiments, the compound of any of the foregoing methods or uses can be administered orally.

Certain Combinations and Combination Therapies

In certain embodiments, a first agent comprising the compound described herein is co-administered with one or more secondary agents. In certain embodiments, such second agents are designed to treat the same disease, disorder, or condition as the first agent described herein. In certain embodiments, such second agents are designed to treat a different disease, disorder, or condition as the first agent described herein. In certain embodiments, a first agent is designed to treat an undesired side effect of a second agent. In certain embodiments, second agents are co-administered with the first agent to treat an undesired effect of the first agent. In certain embodiments, such second agents are designed to treat an undesired side effect of one or more pharmaceutical compositions as described herein. In certain embodiments, second agents are co-administered with the first agent to produce a combinational effect. In certain embodiments, second agents are co-administered with the first agent to produce a synergistic effect. In certain embodiments, the co-administration of the first and second agents permits use of lower dosages than would be required to achieve a therapeutic or prophylactic effect if the agents were administered as independent therapy.

In certain embodiments, one or more compounds or compositions provided herein are co-administered with one or more secondary agents. In certain embodiments, one or more compounds or compositions provided herein and one or more secondary agents, are administered at different times. In certain embodiments, one or more compounds or compositions provided herein and one or more secondary agents, are prepared together in a single formulation. In certain embodiments, one or more compounds or compositions provided herein and one or more secondary agents, are prepared separately.

Certain embodiments are directed to the use of a compound comprising a modified oligonucleotide complementary to a DNM2 nucleic acid transcript as described herein in combination with a secondary agent. In particular embodiments such use is in a method of treating a patient suffering from CNM, DMD, or CMT, or in the preparation or manufacture of a medicament for treating CNM, DMD, or CMT.

In certain embodiments the compound comprising a modified oligonucleotide complementary to a DNM2 nucleic acid transcript as described herein and the secondary agent are used in combination treatment by administering the two agents simultaneously, separately or sequentially. In certain embodiments the two agents are formulated as a fixed dose combination product. In other embodiments the two agents are provided to the patient as separate units which can then either be taken simultaneously or serially (sequentially).

Certain Compounds

In certain embodiments, compounds described herein can be antisense compounds. In certain embodiments, the antisense compound comprises or consists of an oligomeric compound. In certain embodiments, the oligomeric compound comprises or consists of a modified oligonucleotide. In certain embodiments, the modified oligonucleotide has a nucleobase sequence complementary to that of a target nucleic acid.

In certain embodiments, a compound described herein comprises or consists of a modified oligonucleotide. In certain embodiments, the modified oligonucleotide has a nucleobase sequence complementary to that of a target nucleic acid.

In certain embodiments, a compound or antisense compound is single-stranded. Such a single-stranded compound or antisense compound comprises or consists of an oligomeric compound. In certain embodiments, such an oligomeric compound comprises or consists of an oligonucleotide and optionally a conjugate group. In certain embodiments, the oligonucleotide is an antisense oligonucleotide. In certain embodiments, the oligonucleotide is modified. In certain embodiments, the oligonucleotide of a single-stranded antisense compound or oligomeric compound comprises a self-complementary nucleobase sequence.

In certain embodiments, a compound or antisense compound is double-stranded. Such double-stranded compounds comprise a first oligomeric compound comprising or consisting of a first modified oligonucleotide having a region complementary to a target nucleic acid and a second oligomeric compound comprising or consisting of a second oligonucleotide having a region complementary to the first modified oligonucleotide. In certain embodiments, the first oligonucleotide is 100% complementary to the second oligonucleotide. In certain embodiments, the first and second oligonucleotides include non-complementary, overhanging nucleosides. In certain embodiments, the first modified oligonucleotide comprises unmodified ribosyl sugar moieties as those found in RNA. In such embodiments, thymine nucleobases in the first and/or second oligonucleotide are replaced by uracil nucleobases. In certain embodiments, the first and/or second oligomeric compound comprises a conjugate group. In certain embodiments, the first modified oligonucleotide is 12-30 linked nucleosides in length and the second oligonucleotide is 12-30 linked nucleosides in length. In certain embodiments, the second oligonucleotide is modified. In certain embodiments, the first modified oligonucleotide has a nucleobase sequence comprising at least 8 contiguous nucleobases of any of SEQ ID NOs: 7-3134.

Examples of single-stranded and double-stranded compounds include but are not limited to oligonucleotides, siRNAs, microRNA targeting oligonucleotides, and single-stranded RNAi compounds, such as small hairpin RNAs (shRNAs), single-stranded siRNAs (ssRNAs), and microRNA mimics.

In certain embodiments, a compound described herein has a nucleobase sequence that, when written in the 5' to 3' direction, comprises the reverse complement of the target segment of a target nucleic acid to which it is targeted.

In certain embodiments, a compound described herein comprises an oligonucleotide 10 to 30 linked subunits in length. In certain embodiments, a compound described herein comprises an oligonucleotide 12 to 30 linked subunits in length. In certain embodiments, a compound described herein comprises an oligonucleotide 12 to 22 linked subunits in length. In certain embodiments, compound described herein comprises an oligonucleotide 14 to 30 linked subunits in length. In certain embodiments, compound described herein comprises an oligonucleotide 14 to 20 linked subunits in length. In certain embodiments, a compound described herein comprises an oligonucleotide 15 to 30 linked subunits in length. In certain embodiments, a compound described herein comprises an oligonucleotide 15 to 20 linked subunits in length. In certain embodiments, a compound described herein comprises an oligonucleotide 16 to 30 linked subunits in length. In certain embodiments, a compound described herein comprises an oligonucleotide 16 to 20 linked subunits in length. In certain embodiments, a compound described herein comprises an oligonucleotide 17 to 30 linked subunits in length. In certain embodiments, a compound described herein comprises an oligonucleotide 17 to 20 linked subunits in length. In certain embodiments, a compound described herein comprises an oligonucleotide 18 to 30 linked subunits in length. In certain embodiments, a compound described herein comprises an oligonucleotide 18 to 21 linked subunits in length. In certain embodiments, a compound described herein comprises an oligonucleotide 18 to 20 linked subunits in length. In certain embodiments, a compound described herein comprises an oligonucleotide 20 to 30 linked subunits in length. In other words, such oligonucleotides are 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits in length, respectively. In certain embodiments, a compound described herein comprises an oligonucleotide 14 linked subunits in length. In certain embodiments, a compound described herein comprises an oligonucleotide 16 linked subunits in length. In certain embodiments, a compound described herein comprises an oligonucleotide 17 linked subunits in length. In certain embodiments, compound described herein comprises an oligonucleotide 18 linked subunits in length. In certain embodiments, a compound described herein comprises an oligonucleotide 19 linked subunits in length. In certain embodiments, a compound described herein comprises an oligonucleotide 20 linked subunits in length. In other embodiments, a compound described herein comprises an oligonucleotide 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the compound described herein comprises an oligonucleotide 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 linked subunits in length, or a range defined by any two of the above values. In some embodiments the linked subunits are nucleotides, nucleosides, or nucleobases.

In certain embodiments, the compound may further comprise additional features or elements, such as a conjugate group, that are attached to the oligonucleotide. In certain embodiments, such compounds are antisense compounds. In certain embodiments, such compounds are oligomeric compounds. In embodiments where a conjugate group comprises a nucleoside (i.e. a nucleoside that links the conjugate group to the oligonucleotide), the nucleoside of the conjugate group is not counted in the length of the oligonucleotide.

In certain embodiments, compounds may be shortened or truncated. For example, a single subunit may be deleted from the 5' end (5' truncation), or alternatively from the 3' end (3' truncation). A shortened or truncated compound targeted to a DNM2 nucleic acid may have two subunits deleted from the 5' end, or alternatively may have two subunits deleted from the 3' end, of the compound. Alternatively, the deleted nucleosides may be dispersed throughout the compound.

When a single additional subunit is present in a lengthened compound, the additional subunit may be located at the 5' or 3' end of the compound. When two or more additional subunits are present, the added subunits may be adjacent to each other, for example, in a compound having two subunits added to the 5' end (5' addition), or alternatively to the 3' end (3' addition), of the compound. Alternatively, the added subunits may be dispersed throughout the compound.

It is possible to increase or decrease the length of a compound, such as an oligonucleotide, and/or introduce mismatch bases without eliminating activity (Woolf et al. *Proc. Natl. Acad. Sci. USA* 1992, 89:7305-7309; Gautschi et al. *J. Natl. Cancer Inst*. March 2001, 93:463-471; Maher and Dolnick *Nuc. Acid. Res.* 1998, 16:3341-3358). However, seemingly small changes in oligonucleotide sequence, chemistry and motif can make large differences in one or more of the many properties required for clinical development (Seth et al. *J. Med. Chem.* 2009, 52, 10; Egli et al. *J. Am. Chem. Soc.* 2011, 133, 16642).

In certain embodiments, compounds described herein are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term "RNAi" is meant to be equivalent to other terms used to describe sequence specific RNA interference, such as post transcriptional gene silencing, translational inhibition, or epigenetics.

In certain embodiments, a compound described herein can comprise any of the oligonucleotide sequences targeted to a DNM2 nucleic acid transcript described herein. In certain embodiments, the compound can be double-stranded. In certain embodiments, the compound comprises a first strand comprising at least an 8, 9, 10, 11, 12, 13, 14, 15, 16, 17, 18, 19, or 20 contiguous nucleobase portion of any one of SEQ ID NOs: 7-3134 and a second strand. In certain embodiments, the compound can be double-stranded. In certain embodiments, the compound comprises a first strand comprising at least an 8, 9, 10, 11, 12, 13, 14, 15, 16, 17, 18, 19, or 20 contiguous nucleobase portion of any one of SEQ ID NOs: 2879, 3056, 2123, 2189, 2453, 2160, or 2232 and a second strand. In certain embodiments, the compound can be double-stranded. In certain embodiments, the compound comprises a first strand comprising at least an 8, 9, 10, 11, 12, 13, 14, 15, 16, 17, 18, 19, or 20 contiguous nucleobase portion of SEQ ID NO: 2879 and a second strand. In certain embodiments, the compound comprises a first strand comprising the nucleobase sequence of any one of SEQ ID NOs: 7-3134 and a second strand. In certain embodiments, the compound comprises a first strand comprising the nucleobase sequence of any one of SEQ ID NOs: 2879, 3056, 2123, 2189, 2453, 2160, or 2232 and a second strand. In certain embodiments, the compound comprises a first strand comprising the nucleobase sequence of SEQ ID NO: 2879 and a second strand. In certain embodiments, the compound comprises ribonucleotides in which the first strand has uracil (U) in place of thymine (T) in any one of SEQ ID NOs: 7-3134. In certain embodiments, the compound comprises (i) a first strand comprising a nucleobase sequence complementary to the site on a DNM2 nucleic acid to which any of SEQ ID NOs: 7-3134 is complementary, and (ii) a second strand. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the dsRNA compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains one or two capped strands, as disclosed, for example, by WO 00/63364, filed Apr. 19, 2000.

In certain embodiments, the first strand of the compound is an siRNA guide strand and the second strand of the compound is an siRNA passenger strand. In certain embodiments, the second strand of the compound is complementary to the first strand. In certain embodiments, each strand of the compound is 16, 17, 18, 19, 20, 21, 22, or 23 linked nucleosides in length. In certain embodiments, the first or second strand of the compound can comprise a conjugate group.

In certain embodiments, a compound described herein can comprise any of the oligonucleotide sequences targeted to a DNM2 nucleic acid described herein. In certain embodiments, the compound is single-stranded. In certain embodiments, such a compound is a single-stranded RNAi (ssRNAi) compound. In certain embodiments, the compound comprises at least an 8, 9, 10, 11, 12, 13, 14, 15, 16, 17, 18, 19, or 20 contiguous nucleobase portion of any one of SEQ ID NOs: 7-3134. In certain embodiments, the compound comprises at least an 8, 9, 10, 11, 12, 13, 14, 15, 16, 17, 18, 19, or 20 contiguous nucleobase portion of any one of SEQ ID NOs: 2879, 3056, 2123, 2189, 2453, 2160, or 2232. In certain embodiments, the compound comprises at least an 8, 9, 10, 11, 12, 13, 14, 15, 16, 17, 18, 19, or 20 contiguous nucleobase portion of SEQ ID NO: 2879. In certain embodiments, the compound comprises the nucleobase sequence of any one of SEQ ID NOs: 7-3134. In certain embodiments, the compound comprises the nucleobase sequence of any one of SEQ ID NOs: 2879, 3056, 2123, 2189, 2453, 2160, or 2232. In certain embodiments, the compound comprises the nucleobase sequence of SEQ ID NO: 2879. In certain embodiments, the compound comprises ribonucleotides in which uracil (U) is in place of thymine (T) in any of SEQ ID NOs: 7-3134. In certain embodiments, the compound comprises a nucleobase sequence complementary to the site on DNM2 to which any of SEQ ID NOs: 7-3134 is targeted. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains a capped strand, as disclosed, for example, by WO 00/63364, filed Apr. 19, 2000. In certain embodiments, the compound consists of 16, 17, 18, 19, 20, 21, 22, or 23 linked nucleosides. In certain embodiments, the compound can comprise a conjugate group.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as a or 13, such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms. All tautomeric forms of the compounds provided herein are included unless otherwise indicated.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

Certain Mechanisms

In certain embodiments, compounds described herein comprise or consist of modified oligonucleotides. In certain embodiments, compounds described herein are antisense compounds. In certain embodiments, compounds comprise oligomeric compounds. In certain embodiments, compounds described herein are capable of hybridizing to a DNM2 target nucleic acid, resulting in at least one antisense activity. In certain embodiments, compounds described herein selectively affect one or more target nucleic acid. Such compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in a significant undesired antisense activity.

In certain antisense activities, hybridization of a compound described herein to a target nucleic acid results in recruitment of a protein that cleaves the target nucleic acid. For example, certain compounds described herein result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, compounds described herein are sufficiently "DNA-like" to elicit RNase H activity. Further, in certain embodiments, one or more non-DNA-like nucleoside in the gap of a gapmer is tolerated.

In certain antisense activities, compounds described herein or a portion of the compound is loaded into an RNA-induced silencing complex (RISC), ultimately resulting in cleavage of the target nucleic acid. For example, certain compounds described herein result in cleavage of the target nucleic acid by Argonaute. Compounds that are loaded into RISC are RNAi compounds. RNAi compounds may be double-stranded (siRNA) or single-stranded (ssRNA).

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

Target Nucleic Acids, Target Regions and Nucleotide Sequences

In certain embodiments, compounds described herein comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: an mRNA and a pre-mRNA, including intronic, exonic and untranslated regions. In certain embodiments, the target RNA is an mRNA. In certain embodiments, the target nucleic acid is a pre-mRNA. In certain embodiments, a pre-mRNA and corresponding mRNA are both target nucleic acids of a single compound. In certain such embodiments, the target region is entirely within an intron of a target pre-mRNA. In certain embodiments, the target region spans an intron/exon junction. In certain embodiments, the target region is at least 50% within an intron. Target nucleic acid sequences that encode DNM2 include, without limitation, the following: RefSeq or GenBank Accession No. NC_000019.10 truncated from nucleosides 10715001 to 10835000, NM_004945.3, NM_001005361.2, or NM_001005360.2 (SEQ ID Nos: 1, 2, 3, and 3135, respectively).

Hybridization

In some embodiments, hybridization occurs between a compound disclosed herein and a DNM2 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Hybridization conditions are sequence-dependent and are determined by the nature and composition of the nucleic acid molecules to be hybridized.

Methods of determining whether a sequence is specifically hybridizable to a target nucleic acid are well known in the art. In certain embodiments, the compounds provided herein are specifically hybridizable with a DNM2 nucleic acid.

Complementarity

In certain embodiments, compounds described herein comprise or consist of modified oligonucleotides. In certain embodiments, compounds described herein are antisense compounds. In certain embodiments, compounds comprise oligomeric compounds. In certain embodiments, oligonucleotides complementary to a DNM2 nucleic acid comprise nucleobase that are non-complementary with the DNM2 nucleic acid, yet may be tolerated provided that the compound remains able to specifically hybridize to a target nucleic acid. Moreover, a compound may hybridize over one or more segments of a DNM2 nucleic acid such that intervening or adjacent segments are not involved in the hybridization event (e.g., a loop structure, mismatch or hairpin structure).

In certain embodiments, the compounds provided herein, or a specified portion thereof, are, are at least, or are up to 70%, 80%, 85%, 86%, 87%, 88%, 89%, 90%, 91%, 92%, 93%, 94%, 95%, 96%, 97%, 98%, 99%, or 100% complementary to a DNM2 nucleic acid, a target region, target segment, or specified portion thereof. In certain embodiments, the compounds provided herein, or a specified portion thereof, are 70% to 75%, 75% to 80%, 80% to 85%, 85% to 90%, 90% to 95%, 95% to 100%, or any number in between these ranges, complementary to a DNM2 nucleic acid, a target region, target segment, or specified portion thereof. Percent complementarity of a compound with a target nucleic acid can be determined using routine methods.

For example, a compound in which 18 of 20 nucleobases of the compound are complementary to a target region, and would therefore specifically hybridize, would represent 90 percent complementarity. In this example, the remaining non-complementary nucleobases may be clustered or interspersed with complementary nucleobases and need not be contiguous to each other or to complementary nucleobases. As such, a compound which is 18 nucleobases in length having four non-complementary nucleobases which are flanked by two regions of complete complementarity with the target nucleic acid would have 77.8% overall complementarity with the target nucleic acid. Percent complementarity of a compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, compounds described herein, or specified portions thereof, are fully complementary (i.e. 100% complementary) to a target nucleic acid, or specified portion thereof. For example, a compound may be 100% complementary to a DNM2 nucleic acid, or a target region, or a target segment or target sequence thereof. As used herein, "fully complementary" means each nucleobase of a compound is complementary to the corresponding nucleobase of a target nucleic acid. For example, a 20 nucleobase compound is fully complementary to a target sequence that is 400 nucleobases long, so long as there is a corresponding 20 nucleobase portion of the target nucleic acid that is fully complementary to the compound. Fully complementary can also be used in reference to a specified portion of the first and/or the second nucleic acid. For example, a 20 nucleobase portion of a 30 nucleobase compound can be "fully complementary" to a target sequence that is 400 nucleobases long. The 20 nucleobase portion of the 30 nucleobase compound is fully complementary to the target sequence if the target sequence has a corresponding 20 nucleobase portion wherein each nucleobase is complementary to the 20 nucleobase portion of the compound. At the same time, the entire 30 nucleobase compound may or may not be fully complementary to the target sequence, depending on whether the remaining 10 nucleobases of the compound are also complementary to the target sequence.

In certain embodiments, compounds described herein comprise one or more mismatched nucleobases relative to the target nucleic acid. In certain such embodiments, antisense activity against the target is reduced by such mismatch, but activity against a non-target is reduced by a greater amount. Thus, in certain such embodiments selectivity of the compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap segment. In certain such embodiments, the mismatch is at position 9, 8, 7, 6, 5, 4, 3, 2, 1 from the 3'-end of the gap segment. In certain such embodiments, the mismatch is at position 1, 2, 3, or 4 from the 5'-end of the wing segment. In certain such embodiments, the mismatch is at position 4, 3, 2, or 1 from the 3'-end of the wing segment. In certain embodiments, the mismatch is specifically positioned within an oligonucleotide not having a gapmer motif. In certain such embodiments, the mismatch is at position 1, 2, 3, 4, 5, 6, 7, 8, 9, 10, 11, or 12 from the 5'-end of the oligonucleotide. In certain such embodiments, the mismatch is at position 1, 2, 3, 4, 5, 6, 7, 8, 9, 10, 11, or 12 from the 3'-end of the oligonucleotide.

The location of a non-complementary nucleobase may be at the 5' end or 3' end of the compound. Alternatively, the non-complementary nucleobase or nucleobases may be at an internal position of the compound. When two or more non-complementary nucleobases are present, they may be contiguous (i.e., linked) or non-contiguous. In one embodiment, a non-complementary nucleobase is located in the wing segment of a gapmer oligonucleotide.

In certain embodiments, compounds described herein that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a DNM2 nucleic acid, or specified portion thereof.

In certain embodiments, compounds described herein that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a DNM2 nucleic acid, or specified portion thereof.

In certain embodiments, compounds described herein also include those which are complementary to a portion (a defined number of contiguous nucleobases within a region or segment) of a target nucleic acid. In certain embodiments, the compounds, are complementary to at least an 8 nucleobase portion of a target segment. In certain embodiments, the compounds are complementary to at least a 9 nucleobase portion of a target segment. In certain embodiments, the compounds are complementary to at least a 10 nucleobase portion of a target segment. In certain embodiments, the compounds are complementary to at least an 11 nucleobase portion of a target segment. In certain embodiments, the compounds are complementary to at least a 12 nucleobase portion of a target segment. In certain embodiments, the compounds are complementary to at least a 13 nucleobase portion of a target segment. In certain embodiments, the compounds are complementary to at least a 14 nucleobase portion of a target segment. In certain embodiments, the compounds are complementary to at least a 15 nucleobase portion of a target segment. In certain embodiments, the compounds are complementary to at least a 16 nucleobase portion of a target segment. Also contemplated are compounds that are complementary to at least a 9, 10, 11, 12, 13, 14, 15, 16, 17, 18, 19, 20, or more nucleobase portion of a target segment, or a range defined by any two of these values.

Certain Compounds

In certain embodiments, compounds described herein comprise or consist of oligonucleotides consisting of linked nucleosides. Oligonucleotides may be unmodified oligonucleotides (RNA or DNA) or may be modified oligonucleotides. Modified oligonucleotides comprise at least one modification relative to unmodified RNA or DNA (i.e., comprise at least one modified nucleoside (comprising a modified sugar moiety and/or a modified nucleobase) and/or at least one modified internucleoside linkage).

I. Modifications

A. Modified Nucleosides

Modified nucleosides comprise a modified sugar moiety or a modified nucleobase or both a modified sugar moiety and a modified nucleobase.

1. Modified Sugar Moieties

In certain embodiments, sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified furanosyl sugar moieties comprising one or more acyclic substituent, including but not limited to substituents at the 2', 4', and/or 5' positions. In certain embodiments, the furanosyl sugar moiety is a ribosyl sugar moiety. In certain embodiments one or more acyclic substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugars comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.).

In certain embodiments, a 2'-substituted nucleoside or 2'-non-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside or 2'-non-bicyclic modified nucleoside comprises a sugar moiety comprising a non-bridging 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted nucleoside or 2'-non-bicyclic modified nucleoside comprises a sugar moiety comprising a non-bridging 2'-substituent group selected from: F, OCH$_3$, and OCH$_2$CH$_2$OCH$_3$.

Nucleosides comprising modified sugar moieties, such as non-bicyclic modified sugar moieties, may be referred to by the position(s) of the substitution(s) on the sugar moiety of the nucleoside. For example, nucleosides comprising 2'-substituted or 2-modified sugar moieties are referred to as 2'-substituted nucleosides or 2-modified nucleosides.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. In certain such embodiments, the furanose ring is a ribose ring. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt" when in the S configuration), 4'-CH$_2$—O—CH$_2$-2', 4'-CH$_2$—N(R)-2', 4'-C—H(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., J. Org. Chem., 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O-2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:
x is 0, 1, or 2;
n is 1, 2, 3, or 4;
each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 20017, 129, 8362-8379; Elayadi et al.,; Wengel et a., U.S. Pat. No. 7,053,207; Imanishi et al., U.S. Pat. No. 6,268,490; Imanishi et al. U.S. Pat. No. 6,770,748; Imanishi et al., U.S. Pat. No. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

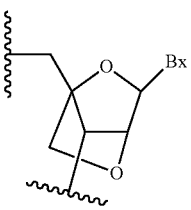

LNA (β-D-configuration)
bridge = 4'-CH$_2$——O-2'

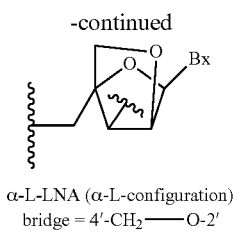

α-L-LNA (α-L-configuration)
bridge = 4'-CH$_2$——O-2'

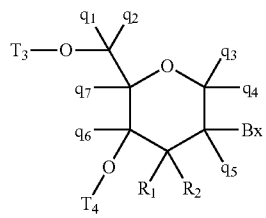

α-L-methyleneoxy (4'-CH$_2$—O-2') or α-L-LNA bicyclic nucleosides have been incorporated into antisense oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

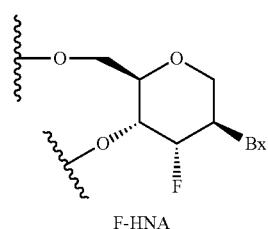

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

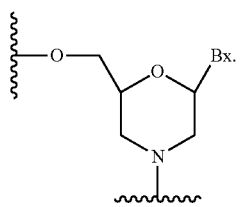

In certain embodiments, morpholinos may be modified, for example by adding or altering various substituent groups from the above morpholino structure. Such sugar surrogates are refered to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.*, 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides).

2. Modified Nucleobases

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manohara et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

In certain embodiments, compounds comprise or consist of a modified oligonucleotide complementary to an α-DNM2 nucleic acid comprising one or more modified nucleobases. In certain embodiments, the modified nucleobase is 5-methylcytosine. In certain embodiments, each cytosine is a 5-methylcytosine.

B. Modified Internucleoside Linkages

In certain embodiments, compounds described herein having one or more modified internucleoside linkages are selected over compounds having only phosphodiester internucleoside linkages because of desirable properties such as, for example, enhanced cellular uptake, enhanced affinity for target nucleic acids, and increased stability in the presence of nucleases.

In certain embodiments, compounds comprise or consist of a modified oligonucleotide complementary to a DNM2 nucleic acid comprising one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P═O") (also referred to as unmodified or naturally occurring linkages), phosphotriesters, methylphosphonates, phosphoramidates, and phosphorothioates ("P═S"), and phosphorodithioates ("HS-P═S"). Representative non-phosphorus containing internucleoside linking groups include but are not limited to methylenemethylimino (—CH$_2$—N(CH$_3$)—O—CH$_2$—), thiodiester, thionocarbamate (—O—C(═O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

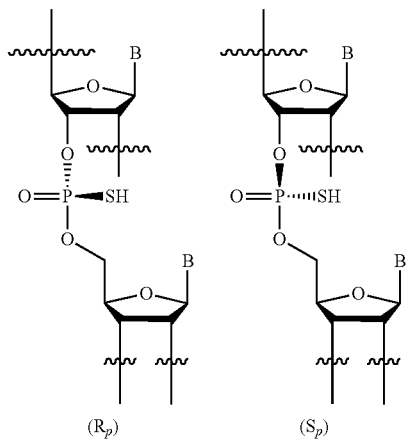

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-$CH_2$—$N(CH_3)$—O-5'), amide-3 (3'-$CH_2$—C(=O)—N(H)-5'), amide-4 (3'-$CH_2$—N(H)—C(=O)-5'), formacetal (3'-O—$CH_2$—O-5'), methoxypropyl, and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook, Eds., ACS Symposium Series 580; Chapters 3 and 4, 40-65). Further neutral internucleoside linkages include nonionic linkages comprising mixed N, O, S and CH2 component parts.

II. Certain Motifs

In certain embodiments, compounds described herein comprise or consist of oligonucleotides. Oligonucleotides can have a motif, e.g. a pattern of unmodified and/or modified sugar moieties, nucleobases, and/or internucleoside linkages. In certain embodiments, modified oligonucleotides comprise one or more modified nucleoside comprising a modified sugar. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns or motifs of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

A. Certain Sugar Motifs

In certain embodiments, compounds described herein comprise or consist of oligonucleotides. In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which comprises two external segments or "wings" and a central or internal segment or "gap." The three segments of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are immediately adjacent to the gap (the 3'-terminal wing nucleoside of the 5'-wing and the 5'-terminal wing nucleoside of the 3'-wing) differ from the sugar moiety of the adjacent gap nucleosides. In certain embodiments, the sugar moieties within the gap are the same as one another. In certain embodiments, the gap includes one or more nucleoside having a sugar moiety that differs from the sugar moiety of one or more other nucleosides of the gap.

In certain embodiments, the wings of a gapmer each comprise 1-5 nucleosides. In certain embodiments, the wings of a gapmer each comprise 2-5 nucleosides. In certain embodiments, the wings of a gapmer each comprise 3-5 nucleosides. In certain embodiments, the nucleosides of the wings of a gapmer are all modified nucleosides. In certain such embodiments, the sugar moieties of the wings of a gapmer are all modified sugar moieties.

In certain embodiments, the gap of a gapmer comprises 7-12 nucleosides. In certain embodiments, the gap of a gapmer comprises 7-10 nucleosides. In certain embodiments, the gap of a gapmer comprises 8-10 nucleosides. In certain embodiments, the gap of a gapmer comprises 10 nucleosides. In certain embodiments, each nucleoside of the gap of a gapmer is a 2'-deoxynucleoside.

In certain embodiments, the gapmer is a deoxy gapmer. In such embodiments, the nucleosides on the gap side of each wing/gap junction are 2'-deoxynucleosides and the terminal wing nucleosides immediately adjacent to the gap comprise modified sugar moieties. In certain such embodiments, each nucleoside of the gap is a 2'-deoxynucleoside. In certain such embodiments, each nucleoside of each wing comprises a modified sugar moiety.

In certain embodiments, a modified oligonucleotide has a fully modified sugar motif wherein each nucleoside of the modified oligonucleotide comprises a modified sugar moiety. In certain embodiments, modified oligonucleotides comprise or consist of a region having a fully modified sugar motif wherein each nucleoside of the region comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified oligonucleotide comprises the same 2'-modification.

B. Certain Nucleobase Motifs

In certain embodiments, compounds described herein comprise or consist of oligonucleotides. In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

C. Certain Internucleoside Linkage Motifs

In certain embodiments, compounds described herein comprise or consist of oligonucleotides. In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P=O). In certain embodiments, each internucleoside linking group of a modified oligonucleotide is a phosphorothioate internucleoside linkage (P=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphate linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

In certain embodiments, oligonucleotides comprise a region having an alternating internucleoside linkage motif. In certain embodiments, oligonucleotides comprise a region of uniformly modified internucleoside linkages. In certain such embodiments, the internucleoside linkages are phosphorothioate internucleoside linkages. In certain embodiments, all of the internucleoside linkages of the oligonucleotide are phosphorothioate internucleoside linkages. In certain embodiments, each internucleoside linkage of the oligonucleotide is selected from phosphodiester or phophate and phosphorothioate. In certain embodiments, each internucleoside linkage of the oligonucleotide is selected from phosphodiester or phosphate and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosponate linkages. In certain embodiments, oligonucleotides having a gapmer nucleoside motif comprise a linkage motif comprising all phosphorothioate linkages except for one or two methylphosponate linkages. In certain embodiments, one methylphosponate linkage is in the gap of an oligonucleotide having a gapmer sugar motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

III. Certain Modified Oligonucleotides

In certain embodiments, compounds described herein comprise or consist of modified oligonucleotides. In certain embodiments, the above modifications (sugar, nucleobase, internucleoside linkage) are incorporated into a modified oligonucleotide. In certain embodiments, modified oligonucleotides are characterized by their modifications, motifs, and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. Likewise, such gapmer oligonucleotides may comprise one or more modified nucleobase independent of the gapmer pattern of the sugar modifications. Furthermore, in certain instances, an oligonucleotide is described by an overall length or range and by lengths or length ranges of two or more regions (e.g., a region of nucleosides having specified sugar modifications), in such circumstances it may be possible to select numbers for each range that result in an oligonucleotide having an overall length falling outside the specified range. In such circumstances, both elements must be satisfied. For example, in certain embodiments, a modified oligonucleotide consists of 15-20 linked nucleosides and has a sugar motif consisting of three regions or segments, A, B, and C, wherein region or segment A consists of 2-6 linked nucleosides having a specified sugar motif, region or segment B consists of 6-10 linked nucleosides having a specified sugar motif, and region or segment C consists of 2-6 linked nucleosides having a specified sugar motif. Such embodiments do not include modified oligonucleotides where A and C each consist of 6 linked nucleosides and B consists of 10 linked nucleosides (even though those numbers of nucleosides are permitted within the requirements for A, B, and C) because the overall length of such oligonucleotide is 22, which exceeds the upper limit of 20 for the overall length of the modified oligonucleotide. Unless otherwise indicated, all modifications are independent of nucleobase sequence except that the modified nucleobase 5-methylcytosine is necessarily a "C" in an oligonucleotide sequence.

In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

In certain embodiments oligonucleotides have a nucleobase sequence that is complementary to a second oligonucleotide or an identified reference nucleic acid, such as a target nucleic acid. In certain embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 70%, at least 80%, at least 90%, at least 95%, or 100% complementary to the second oligonucleotide or nucleic acid, such as a target nucleic acid.

IV. Certain Conjugated Compounds

In certain embodiments, the compounds described herein comprise or consist of an oligonucleotide (modified or unmodified) and optionally one or more conjugate groups and/or terminal groups. Conjugate groups consist of one or more conjugate moiety and a conjugate linker that links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide.

Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N.Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoaras et al., *EMBO J.* 1991, 10, 1111-1118; Kabanov et al., *FEBS Lett.*, 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic, a palmityl moiety (Mishra et al., *Biochim. Biophys. Acta*, 1995, 1264, 229-237), an octadecylamine or hexylamino-carbonyl-oxycholesterol moiety (Crooke et al., *J. Pharmacol. Exp. Ther.*, 1996, i, 923-937), a tocopherol group (Nishina et al., *Molecular Therapy Nucleic Acids*, 2015, 4, e220; doi:10.1038/mtna.2014.72 and Nishina et al., *Molecular Therapy*, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain compounds, a conjugate group is a single chemical bond (i.e. conjugate moiety is attached to an oligonucleotide via a conjugate linker through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the compound after it reaches a target tissue. Accordingly, linker-nucleosides are typically linked to one another and to the remainder of the compound through cleavable bonds. In certain embodiments, such cleavable bonds are phosphodiester bonds.

Herein, linker-nucleosides are not considered to be part of the oligonucleotide. Accordingly, in embodiments in which a compound comprises an oligonucleotide consisting of a specified number or range of linked nucleosides and/or a specified percent complementarity to a reference nucleic acid and the compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, a compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such a compound is more than 30. Alternatively, an compound may comprise a modified oligonucleotide consisting of 8-30 nucleosides and no conjugate group. The total number of contiguous linked nucleosides in such a compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances compounds comprising a particular conjugate moiety are better taken up by a particular cell type, but once the compound has been taken up, it is desirable that the conjugate group be cleaved to release the unconjugated or parent oligonucleotide. Thus, certain conjugate may comprise one or more cleavable moieties, typically within the conjugate linker. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, one or more linker-nucleosides are linked to one another and/or to the remainder of the compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

3. Certain Cell-Targeting Conjugate Moieties

In certain embodiments, a conjugate group comprises a cell-targeting conjugate moiety. In certain embodiments, a conjugate group has the general formula:

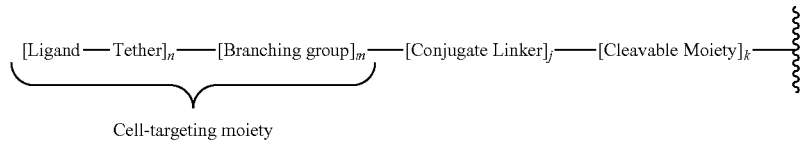

Cell-targeting moiety wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

In certain embodiments, the cell-targeting moiety comprises a branching group comprising one or more groups selected from alkyl, amino, oxo, amide, disulfide, polyethylene glycol, ether, thioether and hydroxylamino groups. In certain embodiments, the branching group comprises a branched aliphatic group comprising groups selected from alkyl, amino, oxo, amide, disulfide, polyethylene glycol, ether, thioether and hydroxylamino groups. In certain such embodiments, the branched aliphatic group comprises groups selected from alkyl, amino, oxo, amide and ether groups. In certain such embodiments, the branched aliphatic group comprises groups selected from alkyl, amino and ether groups. In certain such embodiments, the branched aliphatic group comprises groups selected from alkyl and ether groups. In certain embodiments, the branching group comprises a mono or polycyclic ring system.

In certain embodiments, each tether of a cell-targeting moiety comprises one or more groups selected from alkyl, substituted alkyl, ether, thioether, disulfide, amino, oxo, amide, phosphodiester, and polyethylene glycol, in any combination. In certain embodiments, each tether is a linear aliphatic group comprising one or more groups selected from alkyl, ether, thioether, disulfide, amino, oxo, amide, and polyethylene glycol, in any combination. In certain embodiments, each tether is a linear aliphatic group comprising one or more groups selected from alkyl, phosphodiester, ether, amino, oxo, and amide, in any combination. In certain embodiments, each tether is a linear aliphatic group comprising one or more groups selected from alkyl, ether, amino, oxo, and amid, in any combination. In certain embodiments, each tether is a linear aliphatic group comprising one or more groups selected from alkyl, amino, and oxo, in any combination. In certain embodiments, each tether is a linear aliphatic group comprising one or more groups selected from alkyl and oxo, in any combination. In certain embodiments, each tether is a linear aliphatic group comprising one or more groups selected from alkyl and phosphodiester, in any combination. In certain embodiments, each tether comprises at least one phosphorus linking group or neutral linking group. In certain embodiments, each tether comprises a chain from about 6 to about 20 atoms in length. In certain embodiments, each tether comprises a chain from about 10 to about 18 atoms in length. In certain embodiments, each tether comprises about 10 atoms in chain length.

In certain embodiments, each ligand of a cell-targeting moiety has an affinity for at least one type of receptor on a target cell. In certain embodiments, each ligand has an affinity for at least one type of receptor on the surface of a mammalian lung cell.

In certain embodiments, each ligand of a cell-targeting moiety is a carbohydrate, carbohydrate derivative, modified carbohydrate, polysaccharide, modified polysaccharide, or polysaccharide derivative. In certain such embodiments, the conjugate group comprises a carbohydrate cluster (see, e.g., Maier et al., "Synthesis of Antisense Oligonucleotides Conjugated to a Multivalent Carbohydrate Cluster for Cellular Targeting," Bioconjugate Chemistry, 2003, 14, 18-29, or Rensen et al., "Design and Synthesis of Novel N-Acetylgalactosamine-Terminated Glycolipids for Targeting of Lipoproteins to the Hepatic Asiaglycoprotein Receptor," J. Med. Chem. 2004, 47, 5798-5808, which are incorporated herein by reference in their entirety).

In certain such embodiments, each ligand is an amino sugar or a thio sugar. For example, amino sugars may be selected from any number of compounds known in the art, such as sialic acid, α-D-galactosamine, β-muramic acid, 2-deoxy-2-methylamino-L-glucopyranose, 4,6-dideoxy-4-formamido-2,3-di-O-methyl-D-mannopyranose, 2-deoxy-2-sulfoamino-D-glucopyranose and N-sulfo-D-glucosamine, and N-glycoloyl-α-neuraminic acid. For example, thio sugars may be selected from 5-Thio-β-D-glucopyranose, methyl 2,3,4-tri-O-acetyl-1-thio-6-O-trityl-α-D-glucopyranoside, 4-thio-β-D-galactopyranose, and ethyl 3,4,6,7-tetra-O-acetyl-2-deoxy-1,5-dithio-α-D-gluco-heptopyranoside.

In certain embodiments compounds described herein comprise a conjugate group found in any of the following references: Lee, Carbohydr Res, 1978, 67, 509-514; Connolly et al., J Biol Chem, 1982, 257, 939-945; Pavia et al., Int J Pep Protein Res, 1983, 22, 539-548; Lee et al., Biochem, 1984, 23, 4255-4261; Lee et al., Glycoconjugate J, 1987, 4, 317-328; Toyokuni et al., Tetrahedron Lett, 1990, 31, 2673-2676; Biessen et al., J Med Chem, 1995, 38, 1538-1546; Valentijn et al., Tetrahedron, 1997, 53, 759-770; Kim et al., Tetrahedron Lett, 1997, 38, 3487-3490; Lee et al., Bioconjug Chem, 1997, 8, 762-765; Kato et al., Glycobiol, 2001, 11, 821-829; Rensen et al., J Biol Chem, 2001, 276, 37577-37584; Lee et al., Methods Enzymol, 2003, 362, 38-43; Westerlind et al., Glycoconj J, 2004, 21, 227-241; Lee et al., Bioorg Med Chem Lett, 2006, 16(19), 5132-5135; Maierhofer et al., Bioorg Med Chem, 2007, 15, 7661-7676; Khorev et al., Bioorg Med Chem, 2008, 16, 5216-5231; Lee et al., Bioorg Med Chem, 2011, 19, 2494-2500; Kornilova et al., Analyt Biochem, 2012, 425, 43-46; Pujol et al., Angew Chemie Int Ed Engl, 2012, 51, 7445-7448; Biessen et al., J Med Chem, 1995, 38, 1846-1852; Sliedregt et al., J Med Chem, 1999, 42, 609-618; Rensen et al., J Med Chem, 2004, 47, 5798-5808; Rensen et al., Arterioscler Thromb Vasc Biol, 2006, 26, 169-175; van Rossenberg et al., Gene Ther, 2004, 11, 457-464; Sato et al., J Am Chem Soc, 2004, 126, 14013-14022; Lee et al., J Org Chem, 2012, 77, 7564-7571; Biessen et al., FASEB J, 2000, 14, 1784-1792; Rajur et al., Bioconjug Chem, 1997, 8, 935-940; Duff et al., Methods Enzymol, 2000, 313, 297-321; Maier et al., Bioconjug Chem, 2003, 14, 18-29; Jayaprakash et al., Org Lett, 2010, 12, 5410-5413; Manoharan, Antisense Nucleic Acid Drug Dev, 2002, 12, 103-128; Merwin et al., Bioconjug Chem, 1994, 5, 612-620; Tomiya et al., Bioorg Med Chem, 2013, 21, 5275-5281; International applications WO1998/013381; WO2011/038356; WO1997/046098; WO2008/098788; WO2004/101619; WO2012/037254; WO2011/120053; WO2011/100131; WO2011/163121; WO2012/177947; WO2013/033230; WO2013/075035; WO2012/083185; WO2012/083046; WO2009/082607; WO2009/134487; WO2010/144740; WO2010/148013; WO1997/020563; WO2010/088537; WO2002/043771; WO2010/129709; WO2012/068187; WO2009/126933; WO2004/024757; WO2010/054406; WO2012/089352; WO2012/089602; WO2013/166121; WO2013/165816; U.S. Pat. Nos. 4,751,219; 8,552,163; 6,908,903; 7,262,177; 5,994,517; 6,300,319; 8,106,022; 7,491,805; 7,491,805; 7,582,744; 8,137,695; 6,383,812; 6,525,031; 6,660,720; 7,723,509; 8,541,548; 8,344,125; 8,313,772; 8,349,308; 8,450,467; 8,501,930; 8,158,601; 7,262,177; 6,906,182; 6,620,916; 8,435,491; 8,404,862; 7,851,615; Published U.S. Patent Application Publications US2011/0097264; US2011/0097265; US2013/0004427; US2005/0164235; US2006/0148740; US2008/0281044; US2010/0240730; US2003/0119724; US2006/0183886; US2008/0206869; US2011/0269814; US2009/0286973; US2011/0207799; US2012/0136042; US2012/0165393; US2008/0281041; US2009/0203135; US2012/0035115; US2012/0095075; US2012/0101148; US2012/0128760; US2012/0157509; US2012/0230938; US2013/0109817; US2013/0121954; US2013/0178512; US2013/0236968; US2011/0123520; US2003/0077829; US2008/0108801; and US2009/0203132.

Compositions and Methods for Formulating Pharmaceutical Compositions

Compounds described herein may be admixed with pharmaceutically acceptable active or inert substances for the preparation of pharmaceutical compositions. Compositions and methods for the formulation of pharmaceutical compositions are dependent upon a number of criteria, including, but not limited to, route of administration, extent of disease, or dose to be administered.

Certain embodiments provide pharmaceutical compositions comprising one or more compounds or a salt thereof. Certain embodiments provide pharmaceutical compositions comprising one or more compounds described herein or a salt thereof. In certain embodiments, the compounds are antisense compounds or oligomeric compounds. In certain embodiments, the compounds comprise or consist of a modified oligonucleotide. In certain such embodiments, the pharmaceutical composition comprises a suitable pharmaceutically acceptable diluent or carrier. In certain embodiments, a pharmaceutical composition comprises a sterile saline solution and one or more compound. In certain embodiments, such pharmaceutical composition consists of a sterile saline solution and one or more compound. In certain embodiments, the sterile saline is pharmaceutical grade saline. In certain embodiments, a pharmaceutical composition comprises one or more compound and sterile water. In certain embodiments, a pharmaceutical composition consists of one compound and sterile water. In certain embodiments, the sterile water is pharmaceutical grade water. In certain embodiments, a pharmaceutical composition comprises or consists of one or more compound and phosphate-buffered saline (PBS). In certain embodiments, a pharmaceutical composition consists of one or more compound and sterile PBS. In certain embodiments, the sterile PBS is pharmaceutical grade PBS. Compositions and methods for the formulation of pharmaceutical compositions are dependent upon a number of criteria, including, but not limited to, route of administration, extent of disease, or dose to be administered.

A compound described herein complementary to a DNM2 nucleic acid can be utilized in pharmaceutical compositions by combining the compound with a suitable pharmaceutically acceptable diluent or carrier and/or additional components such that the pharmaceutical composition is suitable for injection. In certain embodiments, a pharmaceutically acceptable diluent is phosphate buffered saline. Accordingly, in one embodiment, employed in the methods described herein is a pharmaceutical composition comprising a compound complementary to a DNM2 nucleic acid and a pharmaceutically acceptable diluent. In certain embodiments, the pharmaceutically acceptable diluent is phosphate buffered saline. In certain embodiments, the compound comprises or consists of a modified oligonucleotide provided herein.

Pharmaceutical compositions comprising compounds provided herein encompass any pharmaceutically acceptable salts, esters, or salts of such esters, or any other oligonucleotide which, upon administration to an animal, including a human, is capable of providing (directly or indirectly) the biologically active metabolite or residue thereof. In certain embodiments, the compounds are antisense compounds or oligomeric compounds. In certain embodiments, the compound comprises or consists of a modified oligonucleotide. Accordingly, for example, the disclosure is also drawn to pharmaceutically acceptable salts of compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of a compound which are cleaved by endogenous nucleases within the body, to form the active compound.

In certain embodiments, the compounds or compositions further comprise a pharmaceutically acceptable carrier or diluent.

EXAMPLES

The Examples below describe the screening process used to identify lead compounds targeted to DNM2. Out of over 3,000 oligonucleotides that were screened, many potent and tolerable oligonucleotides were identified, and compounds 951799, 949935, 950023, 950089, 951372, 950060, and 950132 emerged as the top lead compounds. In particular, compound 951799 exhibited the best combination of properties in terms of potency and tolerability.

Non-Limiting Disclosure and Incorporation by Reference

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine nucleobase could be described as a DNA having an RNA sugar, or as an RNA having a DNA nucleobase.

Accordingly, nucleic acid sequences provided herein, including, but not limited to those in the sequence listing, are intended to encompass nucleic acids containing any combination of unmodified or modified RNA and/or DNA, including, but not limited to such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGATCG" and compounds having other modified nucleobases, such as "AT$^m$CGAUCG," wherein $^m$C indicates a cytosine base comprising a methyl group at the 5-position.

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Effect of Modified Oligonucleotides Complementary to Dynamin 2 In Vitro Modified oligonucleotides complementary to one or more dynamin 2 (DNM2) nucleic acids were designed and tested for their effect on dynamin 2 mRNA expression in vitro. The modified oligonucleotides were tested in a series of experiments that had similar culture conditions.

A431 cells were cultured at a density of 10,000 cells per well and treated with 4,000 nM modified oligonucleotide via free uptake or no modified oligonucleotide for untreated controls. After approximately 24 hours, RNA was isolated from the cells and DNM2 mRNA levels were measured by quantitative real-time PCR. Human primer probe set RTS36027 (forward sequence GACCTCATGCCAAAGAC-CAT, designated herein as SEQ ID NO: 4; reverse sequence GTCTGCCGAGGAGTATAGGTA, designated herein as SEQ ID NO: 5; probe sequence CCTTCATCCAC-CACGAGCTGCT, designated herein as SEQ ID: 6) was used to measure mRNA levels. DNM2 mRNA levels were normalized to total RNA content, as measured by RIBOGREEN®. Results are presented in the tables below as normalized DNM2 mRNA level, relative to untreated control cells.

The modified oligonucleotides in the tables below each have a 3-10-3 cEt gapmer motif, wherein the central gap segment contains ten 2'-deoxynucleosides and is flanked by wing segments on the 3' and 5' ends, each containing three cEt nucleosides. All cytosine residues throughout each modified oligonucleotide are 5-methyl cytosines. All internucleoside linkages are phosphorothioate internucleoside linkages.

Each modified oligonucleotide listed in the table below is 100% complementary to human DNM2 nucleic acid sequence GENBANK Number NC_000019.10, truncated from 10715001 to 1083500 (designated herein as SEQ ID NO: 1) and/or GENBANK Number NM_004945.3 (designated herein as SEQ ID NO: 2). "Start Site" indicates the 5'-most nucleoside of the DNM2 nucleic acid to which the oligonucleotide is complementary. "Stop Site" indicates the 3'-most nucleoside of the DNM2 nucleic acid to which the oligonucleotide is complementary. 'N/A' indicates that the modified oligonucleotide is not 100% complementary to the particular nucleic acid. Several oligonucleotides match two or more sites on a nucleic acid, as shown in the table below.

As shown below, modified oligonucleotides complementary to human DNM2 inhibited human DNM2 mRNA expression.

TABLE 1

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 694793 | 3066 | 3081 | CTCAGGCGACACCCGA | 96 | 14 | 29 | 7 |
| 694833 | 60707 | 60722 | GATGAGGGTCAAGTTC | 20 | 580 | 595 | 8 |
| 694838 | 60773 | 60788 | CTTGATCTGGTACTCG | 5 | 646 | 661 | 9 |
| 694852 | N/A | N/A | GTCCGTAGGCCTTGGG | 46 | 774 | 789 | 10 |
| 694853 | 62119 | 62134 | ACCGATGGTCCGTAGG | 76 | 781 | 796 | 11 |
| 695014 | 115999 | 116014 | AATGGTGGGCCGGCTG | 99 | N/A | N/A | 12 |
| 695171 | 82451 | 82466 | ACACACTTCAAACTCG | 7 | N/A | N/A | 13 |
| 695171 | 82451 | 82466 | ACACACTTCAAACTCG | 9 | N/A | N/A | 13 |
| 695171 | 82451 | 82466 | ACACACTTCAAACTCG | 5 | N/A | N/A | 13 |
| 695171 | 82451 | 82466 | ACACACTTCAAACTCG | 6 | N/A | N/A | 13 |
| 695171 | 82451 | 82466 | ACACACTTCAAACTCG | 7 | N/A | N/A | 13 |
| 695171 | 82451 | 82466 | ACACACTTCAAACTCG | 8 | N/A | N/A | 13 |
| 695171 | 82451 | 82466 | ACACACTTCAAACTCG | 6 | N/A | N/A | 13 |
| 695171 | 82451 | 82466 | ACACACTTCAAACTCG | 6 | N/A | N/A | 13 |
| 907925 | 3055 | 3070 | CCCGACCCGAGCGACC | 96 | 3 | 18 | 14 |
| 907926 | 3057 | 3072 | CACCCGACCCGAGCGA | 77 | 5 | 20 | 15 |
| 907927 | 3059 | 3074 | GACACCCGACCCGAGC | 115 | 7 | 22 | 16 |
| 907928 | 3062 | 3077 | GGCGACACCCGACCCG | 96 | 10 | 25 | 17 |
| 907929 | 3069 | 3084 | GTTCTCAGGCGACACC | 101 | 17 | 32 | 18 |
| 907930 | 3072 | 3087 | CCGGTTCTCAGGCGAC | 95 | 20 | 35 | 19 |
| 907931 | 3075 | 3090 | CATCCGGTTCTCAGGC | 58 | 23 | 38 | 20 |
| 907932 | 3078 | 3093 | CCTCATCCGGTTCTCA | 47 | 26 | 41 | 21 |
| 907933 | 3083 | 3098 | CGCCGCCTCATCCGGT | 69 | 31 | 46 | 22 |
| 907934 | 3086 | 3101 | GGTCGCCGCCTCATCC | 65 | 34 | 49 | 23 |
| 907935 | 3089 | 3104 | CACGGTCGCCGCCTCA | 29 | 37 | 52 | 24 |
| 907936 | 3091 | 3106 | CTCACGGTCGCCGCCT | 42 | 39 | 54 | 25 |
| 907937 | 3093 | 3108 | GCCTCACGGTCGCCGC | 65 | 41 | 56 | 26 |
| 907938 | 3095 | 3110 | CGGCCTCACGGTCGCC | 106 | 43 | 58 | 27 |
| 907939 | 3098 | 3113 | GCTCGGCCTCACGGTC | 44 | 46 | 61 | 28 |
| 907940 | 3101 | 3116 | CCGGCTCGGCCTCACG | 87 | 49 | 64 | 29 |
| 907941 | 3111 | 3126 | ACGCCCGCTCCCGGCT | 100 | 59 | 74 | 30 |
| 907942 | 3123 | 3138 | GGCCTCGGCAAGACGC | 96 | 71 | 86 | 31 |
| 907943 | 3126 | 3141 | CCGGGCCTCGGCAAGA | 97 | 74 | 89 | 32 |
| 907944 | 3129 | 3144 | CGCCCGGGCCTCGGCA | 84 | 77 | 92 | 33 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 907945 | 3144 | 3159 | CCGTTGCTCCCCGCCC | 5 | 92 | 107 | 34 |
| 907946 | 3146 | 3161 | AGCCGTTGCTCCCCGC | 12 | 94 | 109 | 35 |
| 907947 | 3149 | 3164 | TGTAGCCGTTGCTCCC | 10 | 97 | 112 | 36 |
| 907948 | 3153 | 3168 | CGTCTGTAGCCGTTGC | 8 | 101 | 116 | 37 |
| 907949 | 3171 | 3186 | AACGACCTGGCCCCGC | 12 | 119 | 134 | 38 |
| 907950 | 3177 | 3192 | ACCCTCAACGACCTGG | 41 | 125 | 140 | 39 |
| 907951 | 3180 | 3195 | CCGACCCTCAACGACC | 26 | 128 | 143 | 40 |
| 907952 | 3182 | 3197 | CGCCGACCCTCAACGA | 54 | 130 | 145 | 41 |
| 907953 | 3186 | 3201 | CCGCCGCCGACCCTCA | 35 | 134 | 149 | 42 |
| 907954 | 3190 | 3205 | TCGCCCGCCGCCGACC | 61 | 138 | 153 | 43 |
| 907955 | 3196 | 3211 | CGCTCCTCGCCCGCCG | 52 | 144 | 159 | 44 |
| 907956 | 3198 | 3213 | TGCGCTCCTCGCCCGC | 120 | 146 | 161 | 45 |
| 907957 | 3201 | 3216 | CCCTGCGCTCCTCGCC | 32 | 149 | 164 | 46 |
| 907958 | 3204 | 3219 | GCGCCCTGCGCTCCTC | 105 | 152 | 167 | 47 |
| 907959 | 3220 | 3235 | GCGGCCCCCGGCCCGA | 90 | 168 | 183 | 48 |
| 907960 | 3302 | 3317 | CTGGCCGATGGAGCTG | 129 | 250 | 265 | 49 |
| 907961 | 3304 | 3319 | CTCTGGCCGATGGAGC | 70 | 252 | 267 | 50 |
| 907962 | 3308 | 3323 | GCAGCTCTGGCCGATG | 46 | 256 | 271 | 51 |
| 907963 | N/A | N/A | GGGAAGGAAGTCCCGG | 97 | 349 | 364 | 52 |
| 907964 | 44749 | 44764 | ATTCCTGAACCGCGGG | 89 | 363 | 378 | 53 |
| 907965 | 44751 | 44766 | CGATTCCTGAACCGCG | 47 | 365 | 380 | 54 |
| 907966 | 44753 | 44768 | GACGATTCCTGAACCG | 11 | 367 | 382 | 55 |
| 907967 | 57491 | 57506 | GACTTGCAGTGCAAAA | 6 | 438 | 453 | 56 |
| 907968 | 57493 | 57508 | TGGACTTGCAGTGCAA | 15 | 440 | 455 | 57 |
| 907969 | 57495 | 57510 | TTTGGACTTGCAGTGC | 2 | 442 | 457 | 58 |
| 907970 | 57499 | 57514 | ACTTTTGGACTTGCA | 5 | 446 | 461 | 59 |
| 907971 | 57526 | 57541 | CCTGCCGGACTTCATC | 17 | 473 | 488 | 60 |
| 907972 | 57529 | 57544 | TCTCCTGCCGGACTTC | 13 | 476 | 491 | 61 |
| 907973 | 57532 | 57547 | CAATCTCCTGCCGGAC | 20 | 479 | 494 | 62 |
| 907974 | 57534 | 57549 | TTCAATCTCCTGCCGG | 25 | 481 | 496 | 63 |
| 907975 | 60711 | 60726 | GGTCGATGAGGGTCAA | 8 | 584 | 599 | 64 |
| 907976 | 60716 | 60731 | CGGGAGGTCGATGAGG | 66 | 589 | 604 | 65 |
| 907977 | 60718 | 60733 | CCCGGGAGGTCGATGA | 117 | 591 | 606 | 66 |
| 907978 | 60722 | 60737 | GATACCCGGGAGGTCG | 55 | 595 | 610 | 67 |
| 907979 | 60724 | 60739 | GTGATACCCGGGAGGT | 11 | 597 | 612 | 68 |
| 907980 | 60728 | 60743 | CTTGGTGATACCCGGG | 57 | 601 | 616 | 69 |
| 907981 | 60734 | 60749 | AGGCACCTTGGTGATA | 40 | 607 | 622 | 70 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 907982 | 60776 | 60791 | GTCCTTGATCTGGTAC | 28 | 649 | 664 | 71 |
| 907983 | 60778 | 60793 | ATGTCCTTGATCTGGT | 8 | 651 | 666 | 72 |
| 907984 | 60784 | 60799 | AGGATCATGTCCTTGA | 58 | 657 | 672 | 73 |
| 907985 | 60788 | 60803 | CTGCAGGATCATGTCC | 35 | 661 | 676 | 74 |
| 907986 | 60798 | 60813 | GGCTGATGAACTGCAG | 56 | 671 | 686 | 75 |
| 907987 | 60806 | 60821 | GCTCTCCCGGCTGATG | 40 | 679 | 694 | 76 |
| 907988 | 60809 | 60824 | GCTGCTCTCCCGGCTG | 68 | 682 | 697 | 77 |
| 907989 | 60826 | 60841 | GTGACAGCCAGAATGA | 26 | 699 | 714 | 78 |
| 907990 | 60842 | 60857 | GTCCATGTTGGCGGGC | 66 | 715 | 730 | 79 |
| 907991 | 60882 | 60897 | CGACTTCCTTGGCCAG | 68 | 755 | 770 | 80 |
| 907992 | 60884 | 60899 | ATCGACTTCCTTGGCC | 99 | 757 | 772 | 81 |
| 907993 | N/A | N/A | TGGTCCGTAGGCCTTG | 72 | 776 | 791 | 82 |
| 907994 | 62116 | 62131 | GATGGTCCGTAGGCCT | 68 | 778 | 793 | 83 |
| 907995 | 62195 | 62210 | TCAACGGGAGCAACTT | 18 | 857 | 872 | 84 |
| 907996 | N/A | N/A | GCCTCTTCTCAACGGG | 105 | 865 | 880 | 85 |
| 907997 | N/A | N/A | TAGCCTCTTCTCAACG | 17 | 867 | 882 | 86 |
| 907998 | 68005 | 68020 | GCACGGATGTCCTTCT | 8 | 924 | 939 | 87 |
| 907999 | 68008 | 68023 | GCTGCACGGATGTCCT | 25 | 927 | 942 | 88 |
| 908000 | 68013 | 68028 | CCAGTGCTGCACGGAT | 17 | 932 | 947 | 89 |
| 908001 | 68057 | 68072 | GTGCCGGTAGGCCGGG | 91 | 976 | 991 | 90 |
| 908002 | 68059 | 68074 | ATGTGCCGGTAGGCCG | 83 | 978 | 993 | 91 |
| 908003 | 68062 | 68077 | GCCATGTGCCGGTAGG | 77 | 981 | 996 | 92 |
| 908004 | 68064 | 68079 | CGGCCATGTGCCGGTA | 90 | 983 | 998 | 93 |
| 908005 | 68096 | 68111 | CGTCTTCTGCAGATGT | 26 | 1015 | 1030 | 94 |
| 908006 | 71583 | 71598 | GCCGGCAGCGACTCCC | 107 | 1059 | 1074 | 95 |
| 908007 | 71586 | 71601 | AGGGCCGGCAGCGACT | 64 | 1062 | 1077 | 96 |
| 908008 | 71589 | 71604 | CGTAGGGCCGGCAGCG | 67 | 1065 | 1080 | 97 |
| 908009 | 71603 | 71618 | TCTGTAGTTTGCTACG | 34 | 1079 | 1094 | 98 |
| 908010 | 71605 | 71620 | GCTCTGTAGTTTGCTA | 42 | 1081 | 1096 | 99 |
| 908011 | 71659 | 71674 | GTCGGGCCGAAAGTTC | 15 | 1135 | 1150 | 100 |
| 908012 | 71681 | 71696 | CTTTGGTTTTGCGGGT | 36 | 1157 | 1172 | 101 |
| 908013 | 78772 | 78787 | GAGTGTCCACCTGATC | 11 | 1235 | 1250 | 102 |
| 908014 | 78786 | 78801 | CCCGGAGAGCTCCAGA | 58 | 1249 | 1264 | 103 |
| 908015 | 78789 | 78804 | GCCCCCGGAGAGCTCC | 71 | 1252 | 1267 | 104 |
| 908016 | 78791 | 78806 | GCGCCCCGGAGAGCT | 129 | 1254 | 1269 | 105 |
| 908017 | 78804 | 78819 | GCGATTGATTCGGGCG | 50 | 1267 | 1282 | 106 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908018 | 78808 | 78823 | AGATGCGATTGATTCG | 14 | 1271 | 1286 | 107 |
| 908019 | 80422 | 80437 | GACTCCATGGATGTTC | 91 | 1369 | 1384 | 108 |
| 908020 | N/A | N/A | GCCCGGTCCTGACTCC | 54 | 1379 | 1394 | 109 |
| 908021 | N/A | N/A | AAGCCCGGTCCTGACT | 81 | 1381 | 1396 | 110 |
| 908022 | 81058 | 81073 | GAAAAGCCCGGTCCTG | 35 | 1384 | 1399 | 111 |
| 908023 | 81061 | 81076 | GGTGAAAAGCCCGGTC | 58 | 1387 | 1402 | 112 |
| 908024 | 81076 | 81091 | GAATGCCAAGTCCGGG | 43 | 1402 | 1417 | 113 |
| 908025 | 81079 | 81094 | CTCGAATGCCAAGTCC | 8 | 1405 | 1420 | 114 |
| 908026 | 81082 | 81097 | GGCCTCGAATGCCAAG | 169 | 1408 | 1423 | 115 |
| 908027 | 81103 | 81118 | GACGACCTGCTTTTTC | 4 | 1429 | 1444 | 116 |
| 908028 | 81106 | 81121 | CTTGACGACCTGCTTT | 13 | 1432 | 1447 | 117 |
| 908029 | 81107 | 81122 | GCTTGACGACCTGCTT | 14 | 1433 | 1448 | 118 |
| 908030 | 81109 | 81124 | CAGCTTGACGACCTGC | 33 | 1435 | 1450 | 119 |
| 908031 | 81111 | 81126 | TTCAGCTTGACGACCT | 5 | 1437 | 1452 | 120 |
| 908032 | 81113 | 81128 | CTTTCAGCTTGACGAC | 22 | 1439 | 1454 | 121 |
| 908033 | 81115 | 81130 | CTCTTTCAGCTTGACG | 7 | 1441 | 1456 | 122 |
| 908034 | 81137 | 81152 | GGTCGACACATTTCAG | 13 | 1463 | 1478 | 123 |
| 908035 | 81139 | 81154 | CAGGTCGACACATTTC | 2 | 1465 | 1480 | 124 |
| 908036 | 81147 | 81162 | TGGATAACCAGGTCGA | 14 | 1473 | 1488 | 125 |
| 908037 | 81160 | 81175 | ATTGATTAGCTCCTGG | 2 | 1486 | 1501 | 126 |
| 908038 | 81170 | 81185 | GCCTAACTGTATTGAT | 22 | 1496 | 1511 | 127 |
| 908039 | 81172 | 81187 | CTGCCTAACTGTATTG | 28 | 1498 | 1513 | 128 |
| 908040 | 81175 | 81190 | ACACTGCCTAACTGTA | 54 | 1501 | 1516 | 129 |
| 908041 | 81182 | 81197 | TACTGGTACACTGCCT | 4 | 1508 | 1523 | 130 |
| 908042 | N/A | N/A | CTGAGCTTACTGGTAC | 19 | 1515 | 1530 | 131 |
| 908043 | N/A | N/A | GAACTGAGCTTACTGG | 10 | 1518 | 1533 | 132 |
| 908044 | N/A | N/A | GGTAGGAACTGAGCTT | 8 | 1523 | 1538 | 133 |
| 908045 | 83499 | 83514 | TCCTCTCGCAACCGGG | 46 | 1539 | 1554 | 134 |
| 908046 | 83502 | 83517 | GTCTCCTCTCGCAACC | 34 | 1542 | 1557 | 135 |
| 908047 | 83505 | 83520 | TCTGTCTCCTCTCGCA | 11 | 1545 | 1560 | 136 |
| 908048 | 83517 | 83532 | GTGACGATTCGCTCTG | 48 | 1557 | 1572 | 137 |
| 908049 | 83522 | 83537 | AAGTGGTGACGATTCG | 5 | 1562 | 1577 | 138 |
| 908050 | 83524 | 83539 | GTAAGTGGTGACGATT | 17 | 1564 | 1579 | 139 |
| 908051 | 83536 | 83551 | CCGTTCCCGGATGTAA | 86 | 1576 | 1591 | 140 |
| 908052 | 83548 | 83563 | CGTTCTCCCCTCCCGT | 9 | 1588 | 1603 | 141 |
| 908053 | N/A | N/A | CAGAAGAATCTGGTCC | 33 | 1606 | 1621 | 142 |
| 908054 | 87290 | 87305 | GTCGATCAGCAGAAGA | 33 | 1615 | 1630 | 143 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908055 | 87294 | 87309 | CAATGTCGATCAGCAG | 16 | 1619 | 1634 | 144 |
| 908056 | 87296 | 87311 | CTCAATGTCGATCAGC | 10 | 1621 | 1636 | 145 |
| 908057 | 87299 | 87314 | CTGCTCAATGTCGATC | 18 | 1624 | 1639 | 146 |
| 908058 | 87302 | 87317 | GGACTGCTCAATGTCG | 58 | 1627 | 1642 | 147 |
| 908059 | 87304 | 87319 | TAGGACTGCTCAATGT | 3 | 1629 | 1644 | 148 |
| 908060 | 87308 | 87323 | GATGTAGGACTGCTCA | 19 | 1633 | 1648 | 149 |
| 908061 | 87311 | 87326 | GTTGATGTAGGACTGC | 3 | 1636 | 1651 | 150 |
| 908062 | 97288 | 97303 | GGCTGATGTTGTTGAT | 31 | 1760 | 1775 | 151 |
| 908063 | 97290 | 97305 | CAGGCTGATGTTGTTG | 36 | 1762 | 1777 | 152 |
| 908064 | 97294 | 97309 | TCATCAGGCTGATGTT | 100 | 1766 | 1781 | 153 |
| 908065 | 97299 | 97314 | GCCTTTCATCAGGCTG | 89 | 1771 | 1786 | 154 |
| 908066 | 97338 | 97353 | TGACTCGGCAGTCAGC | 86 | 1810 | 1825 | 155 |
| 908067 | 97341 | 97356 | CAGTGACTCGGCAGTC | 24 | 1813 | 1828 | 156 |
| 908068 | 97345 | 97360 | AGGACAGTGACTCGGC | 17 | 1817 | 1832 | 157 |
| 908069 | 105015 | 105030 | ATCACGGATCTTGAGG | 40 | 1885 | 1900 | 158 |
| 908070 | 105019 | 105034 | CCACATCACGGATCTT | 12 | 1889 | 1904 | 159 |
| 908071 | 105020 | 105035 | TCCACATCACGGATCT | 31 | 1890 | 1905 | 160 |
| 908072 | 105022 | 105037 | TCTCCACATCACGGAT | 72 | 1892 | 1907 | 161 |
| 908073 | 105060 | 105075 | GAAGATGGCGAAGACG | 81 | 1930 | 1945 | 162 |
| 908074 | 108791 | 108806 | CAGGTCCTTGTAGACG | 60 | 1963 | 1978 | 163 |
| 908075 | 108804 | 108819 | GCTCGATCTGCCGCAG | 55 | 1976 | 1991 | 164 |
| 908076 | 108806 | 108821 | CAGCTCGATCTGCCGC | 54 | 1978 | 1993 | 165 |
| 908077 | 108857 | 108872 | TCGGAGGAACGAGGCC | 80 | 2029 | 2044 | 166 |
| 908078 | 108859 | 108874 | GCTCGGAGGAACGAGG | 67 | 2031 | 2046 | 167 |
| 908079 | 108861 | 108876 | CAGCTCGGAGGAACGA | 59 | 2033 | 2048 | 168 |
| 908080 | 108863 | 108878 | GCCAGCTCGGAGGAAC | 93 | 2035 | 2050 | 169 |
| 908081 | N/A | N/A | GCCTGGTCCTTCTCGG | 70 | 2058 | 2073 | 170 |
| 908082 | 110075 | 110090 | AGGTGTTCTCCTGGGC | 74 | 2090 | 2105 | 171 |
| 908083 | 110077 | 110092 | GAAGGTGTTCTCCTGG | 81 | 2092 | 2107 | 172 |
| 908084 | 110080 | 110095 | GGAGAAGGTGTTCTCC | 119 | 2095 | 2110 | 173 |
| 908085 | 110160 | 110175 | ATGGACTTGTTGATGA | 11 | 2175 | 2190 | 174 |
| 908086* | 110166 | 110181 | TCGCGGATGGACTTGT | 36 | 2181 | 2196 | 175 |
| 908087* | 110168 | 110183 | GGTCGCGGATGGACTT | 58 | 2183 | 2198 | 176 |
| 908088* | 110171 | 110186 | TGAGGTCGCGGATGGA | 4 | 2186 | 2201 | 177 |
| 908089* | 114042 | 114057 | CGTGGTGGATGAAGGC | 3 | 2243 | 2258 | 178 |
| 908090* | 114069 | 114084 | CCGAGGAGTATAGGTA | 17 | 2270 | 2285 | 179 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908091* | 114072 | 114087 | CTGCCGAGGAGTATAG | 14 | 2273 | 2288 | 180 |
| 908092* | 114074 | 114089 | GTCTGCCGAGGAGTAT | 11 | 2275 | 2290 | 181 |
| 908093* | 114077 | 114092 | CTGGTCTGCCGAGGAG | 9 | 2278 | 2293 | 182 |
| 908094* | 114080 | 114095 | GCTCTGGTCTGCCGAG | 39 | 2281 | 2296 | 183 |
| 908095 | 115141 | 115156 | CTGGACACCGGTCGGC | 39 | 2484 | 2499 | 184 |
| 908096 | 115144 | 115159 | ATGCTGGACACCGGTC | 47 | 2487 | 2502 | 185 |
| 908097 | 115146 | 115161 | GTATGCTGGACACCGG | 33 | 2489 | 2504 | 186 |
| 908098 | 115150 | 115165 | GGGTGTATGCTGGACA | 11 | 2493 | 2508 | 187 |
| 908099 | 115214 | 115229 | CACGGGAACAGGAATC | 25 | 2557 | 2572 | 188 |
| 908100 | 115221 | 115236 | CTGCCCCCACGGGAAC | 80 | 2564 | 2579 | 189 |
| 908101 | 115238 | 115253 | CGCCGAGAAGGAGGCT | 97 | 2581 | 2596 | 190 |
| 908102 | 115283 | 115298 | GTTGGCAAACACGCTC | 16 | 2626 | 2641 | 191 |
| 908103 | 115285 | 115300 | CTGTTGGCAAACACGC | 30 | 2628 | 2643 | 192 |
| 908104 | 115292 | 115307 | GAGGTCACTGTTGGCA | 9 | 2635 | 2650 | 193 |
| 908105 | 115324 | 115339 | GGCCGAGATGGGATCT | 73 | 2667 | 2682 | 194 |
| 908106 | 115326 | 115341 | CTGGCCGAGATGGGAT | 45 | 2669 | 2684 | 195 |
| 908107 | 115329 | 115344 | GAACTGGCCGAGATGG | 6 | 2672 | 2687 | 196 |
| 908108 | 115332 | 115347 | TCCGAACTGGCCGAGA | 33 | 2675 | 2690 | 197 |
| 908109 | 115336 | 115351 | GGGATCCGAACTGGCC | 82 | 2679 | 2694 | 198 |
| 908110 | 116010 | 116025 | GCTGGGCGGATAATGG | 45 | 2754 | 2769 | 199 |
| 908111 | 116015 | 116030 | GCTCGGCTGGGCGGAT | 101 | 2759 | 2774 | 200 |
| 908112 | 116017 | 116032 | TGGCTCGGCTGGGCGG | 89 | 2761 | 2776 | 201 |
| 908113 | 116022 | 116037 | AGGGATGGCTCGGCTG | 75 | 2766 | 2781 | 202 |
| 908114 | 116030 | 116045 | AGTCGAGCAGGGATGG | 53 | 2774 | 2789 | 203 |
| 908115 | 116035 | 116050 | GGCCTAGTCGAGCAGG | 104 | 2779 | 2794 | 204 |
| 908116 | 116038 | 116053 | CGAGGCCTAGTCGAGC | 79 | 2782 | 2797 | 205 |
| 908117 | 116042 | 116057 | CCCTCGAGGCCTAGTC | 87 | 2786 | 2801 | 206 |
| 908118 | 116045 | 116060 | CCCCCCTCGAGGCCTA | 69 | 2789 | 2804 | 207 |
| 908119 | 116047 | 116062 | CGCCCCCTCGAGGCC | 89 | 2791 | 2806 | 208 |
| 908120 | 116057 | 116072 | CCCGAGAGCACGCCCC | 40 | 2801 | 2816 | 209 |
| 908121 | 116060 | 116075 | CCCCCCGAGAGCACGC | 38 | 2804 | 2819 | 210 |
| 908122 | 116063 | 116078 | GGCCCCCCCGAGAGCA | 95 | 2807 | 2822 | 211 |
| 908123 | 116068 | 116083 | CGTGAGGCCCCCCCGA | 67 | 2812 | 2827 | 212 |
| 908124 | 116088 | 116103 | AAGCTCCTGCGCCGCG | 55 | 2832 | 2847 | 213 |
| 908125 | 116096 | 116111 | GACCACTGAAGCTCCT | 32 | 2840 | 2855 | 214 |
| 908126 | 116098 | 116113 | CAGACCACTGAAGCTC | 38 | 2842 | 2857 | 215 |
| 908127 | 116108 | 116123 | CGGAGGGCCCCAGACC | 100 | 2852 | 2867 | 216 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908128 | 116110 | 116125 | GGCGGAGGGCCCCAGA | 91 | 2854 | 2869 | 217 |
| 908129 | 116128 | 116143 | TGGTCCCAGCATAGGG | 88 | 2872 | 2887 | 218 |
| 908130 | 116130 | 116145 | CCTGGTCCCAGCATAG | 73 | 2874 | 2889 | 219 |
| 908131 | 116138 | 116153 | ACTGGGAGCCTGGTCC | 72 | 2882 | 2897 | 220 |
| 908132 | 116164 | 116179 | CGTTAAGGAAGAGGCC | 69 | 2908 | 2923 | 221 |
| 908133 | 116209 | 116224 | GCGGTGTCCAGCCAGG | 49 | 2953 | 2968 | 222 |
| 908134 | 116211 | 116226 | GTGCGGTGTCCAGCCA | 37 | 2955 | 2970 | 223 |
| 908135 | 116215 | 116230 | CGCAGTGCGGTGTCCA | 13 | 2959 | 2974 | 224 |
| 908136 | 116218 | 116233 | TTGCGCAGTGCGGTGT | 29 | 2962 | 2977 | 225 |
| 908137 | 116220 | 116235 | CTTTGCGCAGTGCGGT | 15 | 2964 | 2979 | 226 |
| 908138 | 116223 | 116238 | CCCCTTTGCGCAGTGC | 12 | 2967 | 2982 | 227 |
| 908139 | 116226 | 116241 | GGGCCCCTTTGCGCAG | 101 | 2970 | 2985 | 228 |
| 908140 | 116228 | 116243 | CAGGGCCCCTTTGCGC | 92 | 2972 | 2987 | 229 |
| 908141 | 116260 | 116275 | TGCAACACCCCAGCGC | 78 | 3004 | 3019 | 230 |
| 908142 | 116265 | 116280 | CAAAGTGCAACACCCC | 20 | 3009 | 3024 | 231 |
| 908143 | 116268 | 116283 | CCCCAAAGTGCAACAC | 47 | 3012 | 3027 | 232 |
| 908144 | 116300 | 116315 | TGGTCCCCCCTCTGCC | 64 | 3044 | 3059 | 233 |
| 908145 | 116309 | 116324 | CAAGGGTTCTGGTCCC | 45 | 3053 | 3068 | 234 |
| 908146 | 116312 | 116327 | TGTCAAGGGTTCTGGT | 15 | 3056 | 3071 | 235 |
| 908147 | 116314 | 116329 | GGTGTCAAGGGTTCTG | 8 | 3058 | 3073 | 236 |
| 908148 | 116318 | 116333 | GGATGGTGTCAAGGGT | 7 | 3062 | 3077 | 237 |
| 908149 | 116331 | 116346 | GACCCCTCATTCAGGA | 84 | 3075 | 3090 | 238 |
| 908150 | 116333 | 116348 | TGGACCCCTCATTCAG | 64 | 3077 | 3092 | 239 |
| 908151 | 116336 | 116351 | GGCTGGACCCCTCATT | 80 | 3080 | 3095 | 240 |
| 908152 | 116348 | 116363 | GAGTCCCCCCCAGGCT | 63 | 3092 | 3107 | 241 |
| 908153 | 116352 | 116367 | GGTAGAGTCCCCCCCA | 31 | 3096 | 3111 | 242 |
| 908154 | 116356 | 116371 | CCTTGGTAGAGTCCCC | 3 | 3100 | 3115 | 243 |
| 908155 | 116359 | 116374 | AGACCTTGGTAGAGTC | 73 | 3103 | 3118 | 244 |
| 908156 | 116385 | 116400 | CCTACATGGGCTTTCC | 37 | 3129 | 3144 | 245 |
| 908157 | 116389 | 116404 | CTGCCCTACATGGGCT | 115 | 3133 | 3148 | 246 |
| 908158 | 116398 | 116413 | ATAGAAGGCCTGCCCT | 71 | 3142 | 3157 | 247 |
| 908159 | 116400 | 116415 | TTATAGAAGGCCTGCC | 41 | 3144 | 3159 | 248 |
| 908160 | 116404 | 116419 | GCACTTATAGAAGGCC | 70 | 3148 | 3163 | 249 |
| 908161 | 116408 | 116423 | GCCCGCACTTATAGAA | 45 | 3152 | 3167 | 250 |
| 908162 | 116410 | 116425 | GTGCCCGCACTTATAG | 66 | 3154 | 3169 | 251 |
| 908163 | 116418 | 116433 | CGCCCTTGGTGCCCGC | 62 | 3162 | 3177 | 252 |

TABLE 1-continued

| | | | DNM2 mRNA Expression | | | |
|---|---|---|---|---|---|---|
| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908164 | 116455 | 116470 | TATACCCCTGCACCCC | 11 | 3199 | 3214 | 253 |
| 908165 | 116464 | 116479 | GGAAGTTGATATACCC | 29 | 3208 | 3223 | 254 |
| 908166 | 116471 | 116486 | GCTAATGGGAAGTTGA | 13 | 3215 | 3230 | 255 |
| 908167 | 116474 | 116489 | CCTGCTAATGGGAAGT | 14 | 3218 | 3233 | 256 |
| 908168 | 116477 | 116492 | GCTCCTGCTAATGGGA | 139 | 3221 | 3236 | 257 |
| 908169 | 116481 | 116496 | GGGAGCTCCTGCTAAT | 102 | 3225 | 3240 | 258 |
| 908170 | 116497 | 116512 | GCCAGGCTTGCCGCTG | 80 | 3241 | 3256 | 259 |
| 908171 | 116499 | 116514 | GGGCCAGGCTTGCCGC | 87 | 3243 | 3258 | 260 |
| 908172 | 116511 | 116526 | ACCGAGCCCACTGGGC | 72 | 3255 | 3270 | 261 |
| 908173 | 116513 | 116528 | CTACCGAGCCCACTGG | 57 | 3257 | 3272 | 262 |
| 908174 | 116518 | 116533 | GGGCACTACCGAGCCC | 87 | 3262 | 3277 | 263 |
| 908175 | 116523 | 116538 | CAGCTGGGCACTACCG | 86 | 3267 | 3282 | 264 |
| 908176 | 116541 | 116556 | TGTACACCTCAGGCCT | 83 | 3285 | 3300 | 265 |
| 908177 | 116544 | 116559 | CTATGTACACCTCAGG | 10 | 3288 | 3303 | 266 |
| 908178 | 116547 | 116562 | GGACTATGTACACCTC | 7 | 3291 | 3306 | 267 |
| 908179 | 116550 | 116565 | GAAGGACTATGTACAC | 8 | 3294 | 3309 | 268 |
| 908180 | 116556 | 116571 | GGCCGGGAAGGACTAT | 51 | 3300 | 3315 | 269 |
| 908181 | 116558 | 116573 | ATGGCCGGGAAGGACT | 78 | 3302 | 3317 | 270 |
| 908182 | 116561 | 116576 | AATATGGCCGGGAAGG | 19 | 3305 | 3320 | 271 |
| 908183 | 116565 | 116580 | GGTTAATATGGCCGGG | 13 | 3309 | 3324 | 272 |
| 908184 | 116573 | 116588 | GGCTGTGTGGTTAATA | 8 | 3317 | 3332 | 273 |
| 908185 | 116603 | 116618 | CCTCTGGCAGCCGAGG | 100 | 3347 | 3362 | 274 |
| 908186 | 116606 | 116621 | GCACCTCTGGCAGCCG | 73 | 3350 | 3365 | 275 |
| 908187 | 116608 | 116623 | AGGCACCTCTGGCAGC | 61 | 3352 | 3367 | 276 |
| 908188 | 116614 | 116629 | TAGCAAAGGCACCTCT | 41 | 3358 | 3373 | 277 |
| 908189 | 116617 | 116632 | GCCTAGCAAAGGCACC | 146 | 3361 | 3376 | 278 |
| 908190 | 116621 | 116636 | CCGGGCCTAGCAAAGG | 60 | 3365 | 3380 | 279 |
| 908191 | 116624 | 116639 | GCTCCGGGCCTAGCAA | 123 | 3368 | 3383 | 280 |
| 908192 | 116626 | 116641 | CGGCTCCGGGCCTAGC | 97 | 3370 | 3385 | 281 |
| 908193 | 116630 | 116645 | CCAACGGCTCCGGGCC | 117 | 3374 | 3389 | 282 |
| 908194 | 116638 | 116653 | GGCCCGGGCCAACGGC | 109 | 3382 | 3397 | 283 |
| 908195 | 116640 | 116655 | CCGGCCCGGGCCAACG | 104 | 3384 | 3399 | 284 |
| 908196 | 116642 | 116657 | GGCCGGCCCGGGCCAA | 99 | 3386 | 3401 | 285 |
| 908197 | 116644 | 116659 | AAGGCCGGCCCGGGCC | 86 | 3388 | 3403 | 286 |
| 908198 | 116646 | 116661 | GCAAGGCCGGCCCGGG | 88 | 3390 | 3405 | 287 |
| 908199 | 116648 | 116663 | GGGCAAGGCCGGCCCG | 125 | 3392 | 3407 | 288 |
| 908200 | 116650 | 116665 | TAGGGCAAGGCCGGCC | 99 | 3394 | 3409 | 289 |

TABLE 1-continued

| | | | DNM2 mRNA Expression | | | | |
|---|---|---|---|---|---|---|---|
| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
| 908201 | 116655 | 116670 | AGGAATAGGGCAAGGC | 6 | 3399 | 3414 | 290 |
| 908202 | 116712 | 116727 | ACCACCCACATAGCCC | 31 | 3456 | 3471 | 291 |
| 908203 | 116729 | 116744 | CAAGACCCCCCGCCAC | 64 | 3473 | 3488 | 292 |
| 908204 | 116732 | 116747 | CCCCAAGACCCCCCGC | 59 | 3476 | 3491 | 293 |
| 908205 | 116738 | 116753 | AGAGGCCCCCAAGACC | 86 | 3482 | 3497 | 294 |
| 908206 | 116772 | 116787 | GGCCCACCCATCAGGG | 110 | 3516 | 3531 | 295 |
| 908207 | 116774 | 116789 | TGGGCCCACCCATCAG | 127 | 3518 | 3533 | 296 |
| 908208 | 116789 | 116804 | AGAGAGAGGCCGCCCT | 37 | 3533 | 3548 | 297 |
| 908209 | 116791 | 116806 | TCAGAGAGAGGCCGCC | 70 | 3535 | 3550 | 298 |
| 908210 | 116808 | 116823 | GAGTGGGTGAGGTCTC | 77 | 3552 | 3567 | 299 |
| 908211 | 116815 | 116830 | GAGCGAGGAGTGGGTG | 59 | 3559 | 3574 | 300 |
| 908212 | 116819 | 116834 | AACTGAGCGAGGAGTG | 55 | 3563 | 3578 | 301 |
| 908213 | 116822 | 116837 | TCAAACTGAGCGAGGA | 5 | 3566 | 3581 | 302 |
| 908214 | 116826 | 116841 | GTGGTCAAACTGAGCG | 15 | 3570 | 3585 | 303 |
| 908215 | 116832 | 116847 | CTTACAGTGGTCAAAC | 10 | 3576 | 3591 | 304 |
| 908216 | 116843 | 116858 | GAGTGCAGGCACTTAC | 48 | 3587 | 3602 | 305 |
| 908217 | 116849 | 116864 | AATACAGAGTGCAGGC | 4 | 3593 | 3608 | 306 |
| 908221 | 82462 | 82477 | CCACGAGATCAACACA | 20 | N/A | N/A | 307 |
| 908222 | 82464 | 82479 | GACCACGAGATCAACA | 88 | N/A | N/A | 308 |
| 908223 | 82465 | 82480 | AGACCACGAGATCAAC | 82 | N/A | N/A | 309 |
| 908224 | 82468 | 82483 | CTGAGACCACGAGATC | 34 | N/A | N/A | 310 |
| 908225 | 82471 | 82486 | GCTCTGAGACCACGAG | 59 | N/A | N/A | 311 |
| 908226 | 82482 | 82497 | GACCGTGGCCAGCTCT | 52 | N/A | N/A | 312 |
| 908227 | 82484 | 82499 | ATGACCGTGGCCAGCT | 54 | N/A | N/A | 313 |
| 908228 | 82485 | 82500 | TATGACCGTGGCCAGC | 31 | N/A | N/A | 314 |
| 908229 | 82487 | 82502 | TTTATGACCGTGGCCA | 64 | N/A | N/A | 315 |
| 908230 | 82488 | 82503 | TTTTATGACCGTGGCC | 102 | N/A | N/A | 316 |
| 908231 | 82498 | 82513 | CGGCACACTTTTTTAT | 37 | N/A | N/A | 317 |
| 908232 | 82502 | 82517 | TTCTCGGCACACTTTT | 4 | N/A | N/A | 318 |
| 908236 | N/A | N/A | CCCCGCCGCGGGCACG | 103 | 3506 | 3521 | 319 |
| 908237 | 4387 | 4402 | CCAAGGAGGGCCCCC | 88 | N/A | N/A | 320 |
| 908238 | 4857 | 4872 | CGCCAGCCTAGTGGCC | 142 | N/A | N/A | 321 |
| 908239 | 5585 | 5600 | TGGGACTACCACCCTA | 129 | N/A | N/A | 322 |
| 908240 | 6095 | 6110 | CTCCATACTGGCCGGC | 91 | N/A | N/A | 323 |
| 908241 | 6449 | 6464 | CTTAACGAGGCCAGCC | 56 | N/A | N/A | 324 |
| 908242 | 7057 | 7072 | ACCCATCTAGGCCCCA | 23 | N/A | N/A | 325 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908243 | 7335 | 7350 | TGGTGCACCGCAGACA | 61 | N/A | N/A | 326 |
| 908244 | 8045 | 8060 | TCAGGAGGCGAGATTG | 93 | N/A | N/A | 327 |
| 908245 | 8318 | 8333 | CGGGAAAACCCCGCCT | 123 | N/A | N/A | 328 |
| 908246 | 8813 | 8828 | AGCCACTAAGTGGCCC | 130 | N/A | N/A | 329 |
| 908247 | 9601 | 9616 | GCTAAACTGGCCTCCG | 78 | N/A | N/A | 330 |
| 908248 | 9989 | 10004 | GCCAACGGGCATCCGA | 104 | N/A | N/A | 331 |
| 908249 | 10650 | 10665 | GTCCACTCCCAGTAGG | 77 | N/A | N/A | 332 |
| 908250 | 11631 | 11646 | GGTGATCCGATGCTGG | 34 | N/A | N/A | 333 |
| 908251 | 12300 | 12315 | GGCCATCTTCCGCCCT | 102 | N/A | N/A | 334 |
| 908252 | 12662 | 12677 | CTAACCTAGGCCGGGT | 70 | N/A | N/A | 335 |
| 908253 | 12991 | 13006 | AGACGCAGGGCCACAT | 66 | N/A | N/A | 336 |
| 908254 | 13381 | 13396 | GGCTCTAGAGGGCCCA | 110 | N/A | N/A | 337 |
| 908255 | 13954 | 13969 | CCGCATACAGCCTTTT | 12 | N/A | N/A | 338 |
| 908256 | 14620 | 14635 | GCATTCCACGGGCAGC | 34 | N/A | N/A | 339 |
| 908257 | 15396 | 15411 | CACCGCTACCCTAGCT | 63 | N/A | N/A | 340 |
| 908258 | 15792 | 15807 | GGGCACCCCGCAGGTT | 102 | N/A | N/A | 341 |
| 908259 | 16235 | 16250 | TCTAGAAGGACCCTGT | 64 | N/A | N/A | 342 |
| 908260 | 16810 | 16825 | AGCCGGGCTTCCGTCT | 84 | N/A | N/A | 343 |
| 908261 | 17238 | 17253 | TTTAAGGGCGCGGTGG | 99 | N/A | N/A | 344 |
| 908262 | 17624 | 17639 | TGCACTTCCGGACAGG | 82 | N/A | N/A | 345 |
| 908263 | 18173 | 18188 | CACCAGCCCAGGCGCG | 117 | N/A | N/A | 346 |
| 908264 | 18617 | 18632 | AGCTAGGTTAATTTCT | 64 | N/A | N/A | 347 |
| 908265 | 19070 | 19085 | CAACATCCCGCCAGGC | 80 | N/A | N/A | 348 |
| 908266 | 19407 | 19422 | AGCAATCTAGCCTCCC | 39 | N/A | N/A | 349 |
| 908267 | 19819 | 19834 | TGCAATGTCCAGTCCT | 11 | N/A | N/A | 350 |
| 908268 | 20435 | 20450 | ACCTAGCAAGCCTACC | 64 | N/A | N/A | 351 |
| 908269 | 21415 | 21430 | GCTACAGCAATATAGA | 67 | N/A | N/A | 352 |
| 908270 | 21839 | 21854 | TCTTAACAGGCTCCCT | 63 | N/A | N/A | 353 |
| 908271 | 22199 | 22214 | CCTCAGGGACGACTTC | 87 | N/A | N/A | 354 |
| 908272 | 22636 | 22651 | TATACGGGCATGTTGA | 55 | N/A | N/A | 355 |
| 908273 | 22916 | 22931 | GTGCATCCCGAGAGGG | 89 | N/A | N/A | 356 |
| 908274 | 23292 | 23307 | ATGAAAGTCTCCACTT | 61 | N/A | N/A | 357 |
| 908275 | 23543 | 23558 | AACCGCTGGGATCCCC | 71 | N/A | N/A | 358 |
| 908276 | 24229 | 24244 | GTACAGGAGTTCCCCA | 90 | N/A | N/A | 359 |
| 908277 | 25038 | 25053 | AAATACACCCTAGATG | 83 | N/A | N/A | 360 |
| 908278 | 25670 | 25685 | GAAGATTTTGGCCGGG | 85 | N/A | N/A | 361 |
| 908279 | 25997 | 26012 | CTCCAGGACACACCGT | 42 | N/A | N/A | 362 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908280 | 27088 | 27103 | GGGAGTAGGCTCGACC | 51 | N/A | N/A | 363 |
| 908281 | 27400 | 27415 | CCCTATTCCACAGGAC | 85 | N/A | N/A | 364 |
| 908282 | 27746 | 27761 | GCTAAGAGCAGCCCTC | 80 | N/A | N/A | 365 |
| 908283 | 28198 | 28213 | GGCATCACGGCCGGGC | 76 | N/A | N/A | 366 |
| 908284 | 29125 | 29140 | TGTCACCCCAGCCGAA | 67 | N/A | N/A | 367 |
| 908285 | 29568 | 29583 | AGCCGGGCACCACCCA | 67 | N/A | N/A | 368 |
| 908286 | 30330 | 30345 | GGCAAGGACAGCCGAC | 94 | N/A | N/A | 369 |
| 908287 | 30334 | 30349 | GTTTGGCAAGGACAGC | 40 | N/A | N/A | 370 |
| 908288 | 30337 | 30352 | GTGGTTTGGCAAGGAC | 14 | N/A | N/A | 371 |
| 908289 | 30340 | 30355 | GCAGTGGTTTGGCAAG | 46 | N/A | N/A | 372 |
| 908290 | 30342 | 30357 | ATGCAGTGGTTTGGCA | 86 | N/A | N/A | 373 |
| 908291 | 30401 | 30416 | TCAACACCTTGAGGGC | 34 | N/A | N/A | 374 |
| 908292 | 30498 | 30513 | TGCCTAGGCGATCCTC | 88 | N/A | N/A | 375 |
| 908293 | 30928 | 30943 | GACATTGCTGTCGCAG | 78 | N/A | N/A | 376 |
| 908294 | 31347 | 31362 | TCCCAAGTGCCCCCCA | 90 | N/A | N/A | 377 |
| 908295 | 31703 | 31718 | AGCCGGCACGGTTGCT | 125 | N/A | N/A | 378 |
| 908296 | 32187 | 32202 | GAGAACATTCGCCCCA | 27 | N/A | N/A | 379 |
| 908297 | 32386 | 32401 | TGACCTGTGGCAATTC | 26 | N/A | N/A | 380 |
| 908298 | 32388 | 32403 | GGTGACCTGTGGCAAT | 44 | N/A | N/A | 381 |
| 908299 | 32689 | 32704 | TCCCGTATCGGCCCCT | 85 | N/A | N/A | 382 |
| 908300 | 33343 | 33358 | GTCCAGCCGCGAGTCC | 59 | N/A | N/A | 383 |
| 908301 | 33635 | 33650 | GGCAGACCCGCAGTCA | 73 | N/A | N/A | 384 |
| 908302 | 34108 | 34123 | GGGCAAGCCACCCCTC | 93 | N/A | N/A | 385 |
| 908303 | 34623 | 34638 | AAGTCGAGCTCCGCCC | 63 | N/A | N/A | 386 |
| 908304 | 35031 | 35046 | TGGTCCTAGCCCGTCC | 78 | N/A | N/A | 387 |
| 908305 | 35549 | 35564 | GGGTACAGGCAAACCT | 88 | N/A | N/A | 388 |
| 908306 | 36028 | 36043 | CCATACCCCCATCTGA | 102 | N/A | N/A | 389 |
| 908307 | 36712 | 36727 | GCGCAGAGGGCCTCGC | 123 | N/A | N/A | 390 |
| 908308 | 37097 | 37112 | CACTACAGACATCCCT | 64 | N/A | N/A | 391 |
| 908309 | 37538 | 37553 | AGCCAGGGCCCGGCTT | 93 | N/A | N/A | 392 |
| 908310 | 38044 | 38059 | CTCCAACTGTAGGGCT | 87 | N/A | N/A | 393 |
| 908311 | 39735 | 39750 | GCGGATGGTGGCATTC | 90 | N/A | N/A | 394 |
| 908312 | 40399 | 40414 | CAGCAGCGGCGGTGAC | 84 | N/A | N/A | 395 |
| 908313 | 41143 | 41158 | CTCTTAGCATGGCCCC | 73 | N/A | N/A | 396 |
| 908314 | 41620 | 41635 | GGCCTGGGATGCTACC | 129 | N/A | N/A | 397 |
| 908315 | 41957 | 41972 | TTAAACCCCCTCTGG | 104 | N/A | N/A | 398 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908316 | 42239 | 42254 | GCCCAAGCCCTCGGCG | 147 | N/A | N/A | 399 |
| 908317 | 42806 | 42821 | ATGCACGCGCTACCAT | 106 | N/A | N/A | 400 |
| 908318 | 43841 | 43856 | ACATATCCTGGCCGGG | 112 | N/A | N/A | 401 |
| 908319 | 44266 | 44281 | CTGGATGTGGGAACGG | 94 | N/A | N/A | 402 |
| 908320 | 44817 | 44832 | CCTCAGGCCGCCCCAT | 57 | N/A | N/A | 403 |
| 908321 | 45179 | 45194 | GGCCATGGAGGGTCAC | 111 | N/A | N/A | 404 |
| 908322 | 45544 | 45559 | GGGACAACTGGCGACA | 39 | N/A | N/A | 405 |
| 908323 | 45952 | 45967 | TGGTAGAGGGCTGGTG | 78 | N/A | N/A | 406 |
| 908324 | 46827 | 46842 | GCCCATCGGCTGCTGT | 153 | N/A | N/A | 407 |
| 908325 | 47604 | 47619 | GGGTAGGCCTGCGCTC | 119 | N/A | N/A | 408 |
| 908326 | 48030 | 48045 | TGCCATGATCAGGCGG | 109 | N/A | N/A | 409 |
| 908327 | 48530 | 48545 | ACCAAGTGGGCACCTA | 92 | N/A | N/A | 410 |
| 908328 | 49088 | 49103 | CCACAAGGCCCCGCCG | 103 | N/A | N/A | 411 |
| 908329 | 49883 | 49898 | GTGACCAGGTGCGGGT | 84 | N/A | N/A | 412 |
| 908330 | 50310 | 50325 | CTGGGCAGAGCCGATC | 95 | N/A | N/A | 413 |
| 908331 | 50840 | 50855 | GACGAGGCTGGCCCTG | 36 | N/A | N/A | 414 |
| 908332 | 51504 | 51519 | CCCCACTGTGCTAAAC | 91 | N/A | N/A | 415 |
| 908333 | 51765 | 51780 | AGTCAGCCGTCCTCGC | 58 | N/A | N/A | 416 |
| 908334 | 52587 | 52602 | CACCAGGCCGAGAGCA | 111 | N/A | N/A | 417 |
| 908335 | 53006 | 53021 | GCCCAGGCACCGACCA | 92 | N/A | N/A | 418 |
| 908336 | 53680 | 53695 | CCCCGGAACCTCAGGC | 85 | N/A | N/A | 419 |
| 908337 | 54271 | 54286 | CAGCACGCTGTGTGCA | 65 | N/A | N/A | 420 |
| 908338 | 54667 | 54682 | CACTCGGCCGCTCTTC | 80 | N/A | N/A | 421 |
| 908339 | 55325 | 55340 | GCGCACTGCCCTGTCG | 77 | N/A | N/A | 422 |
| 908340 | 56452 | 56467 | CAAGAGGGCCCCCTAC | 110 | N/A | N/A | 423 |
| 908341 | 56855 | 56870 | TATGAATCCCCCTCCC | 99 | N/A | N/A | 424 |
| 908342 | 57413 | 57428 | GCGCATGGACTGCGGG | 150 | N/A | N/A | 425 |
| 908343 | 57695 | 57710 | TGGAAGTACACAGGCT | 40 | N/A | N/A | 426 |
| 908344 | 58949 | 58964 | GTCTATGGCCCCGGGC | 102 | N/A | N/A | 427 |
| 908345 | 59713 | 59728 | GCATAGGCCAACGCAG | 88 | N/A | N/A | 428 |
| 908346 | 60635 | 60650 | AAACAGGCCCGCAGCC | 95 | N/A | N/A | 429 |
| 908347 | 61004 | 61019 | CCTACAGCGGCCATGG | 115 | N/A | N/A | 430 |
| 908348 | 61545 | 61560 | GTGCTAACCGTGTGTG | 85 | N/A | N/A | 431 |
| 908349 | 62025 | 62040 | GTCCAGTTGGCCCTGA | 84 | N/A | N/A | 432 |
| 908350 | 62964 | 62979 | AACCACCGAAGCTGGG | 125 | N/A | N/A | 433 |
| 908351 | 63324 | 63339 | GGAAGATGGCCGGGTG | 111 | N/A | N/A | 434 |
| 908352 | 63675 | 63690 | GCTACAATGCCTAGGA | 85 | N/A | N/A | 435 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908353 | 64393 | 64408 | GGTCAACGCAGGCTCA | 48 | N/A | N/A | 436 |
| 908354 | 64657 | 64672 | AGCCAGGAGCAATCGC | 78 | N/A | N/A | 437 |
| 908355 | 65114 | 65129 | GGCAACCAAGGTCTGA | 15 | N/A | N/A | 438 |
| 908356 | 65639 | 65654 | CGCCTAGCCTGGGTTC | 67 | N/A | N/A | 439 |
| 908357 | 66042 | 66057 | CACCATCACACACGGA | 44 | N/A | N/A | 440 |
| 908358 | 66433 | 66448 | GGGAGAGGTGCCGGTC | 99 | N/A | N/A | 441 |
| 908359 | 66885 | 66900 | CACCGAGAAGGAGGTA | 99 | N/A | N/A | 442 |
| 908360 | 67650 | 67665 | AAAATCTCGGCCGGGA | 101 | N/A | N/A | 443 |
| 908361 | 67903 | 67918 | GCCAAGTGGACCTGGC | 84 | N/A | N/A | 444 |
| 908362 | 68192 | 68207 | GCCTGAAACAAGTGCC | 75 | N/A | N/A | 445 |
| 908363 | 68628 | 68643 | CCCCAGGCAATGCATA | 125 | N/A | N/A | 446 |
| 908364 | 68993 | 69008 | AGAACGATAGGCCAGG | 52 | N/A | N/A | 447 |
| 908365 | 69310 | 69325 | TCTTTTCCCGGCCCCC | 48 | N/A | N/A | 448 |
| 908366 | 71364 | 71379 | CGGCACGGAGCTGCCC | 126 | N/A | N/A | 449 |
| 908367 | 71557 | 71572 | GGTCAGTTGCTGCAGG | 40 | N/A | N/A | 450 |
| 908368 | 72040 | 72055 | GGCCGGCCAATGCTCA | 118 | N/A | N/A | 451 |
| 908369 | 73315 | 73330 | TTGCACTGGCCGGGCT | 75 | N/A | N/A | 452 |
| 908370 | 73937 | 73952 | CCCTTAGCCCACGACC | 92 | N/A | N/A | 453 |
| 908371 | 74402 | 74417 | CTGCCAGTTTGTCCCC | 25 | N/A | N/A | 454 |
| 908372 | 74408 | 74423 | TGTAATCTGCCAGTTT | 53 | N/A | N/A | 455 |
| 908373 | 74410 | 74425 | CTTGTAATCTGCCAGT | 55 | N/A | N/A | 456 |
| 908374 | 74415 | 74430 | GGCACCTTGTAATCTG | 96 | N/A | N/A | 457 |
| 908375 | 74908 | 74923 | TGTGATGGGCATCCCC | 56 | N/A | N/A | 458 |
| 908376 | 75761 | 75776 | ATACATGAGGTCCGGG | 106 | N/A | N/A | 459 |
| 908377 | 76583 | 76598 | GCCCAACCCACGCTGC | 79 | N/A | N/A | 460 |
| 908378 | 77237 | 77252 | CCCCAACTGGGAGAGG | 107 | N/A | N/A | 461 |
| 908379 | 77517 | 77532 | TAGAACGGGCCTGGCC | 93 | N/A | N/A | 462 |
| 908380 | 78331 | 78346 | TCCATAGGTTCCCGCC | 89 | N/A | N/A | 463 |
| 908381 | 78849 | 78864 | GGGCACTACCTTCACC | 138 | N/A | N/A | 464 |
| 908382 | 79488 | 79503 | TCCCACGGATTATAGG | 140 | N/A | N/A | 465 |
| 908383 | 80002 | 80017 | GCCCAGGAAGGTCGAA | 105 | N/A | N/A | 466 |
| 908384 | 80333 | 80348 | ATGCATGGAGGCACCC | 93 | N/A | N/A | 467 |
| 908385 | 80626 | 80641 | TGCAATGGACGCAGGA | 37 | N/A | N/A | 468 |
| 908386 | 80968 | 80983 | GGCCGGGTCCCCAACA | 113 | N/A | N/A | 469 |
| 908387 | 81643 | 81658 | GGCCATTCCCGGAGCT | 114 | N/A | N/A | 470 |
| 908388 | 82021 | 82036 | CCTTTTCTAATCGAAG | 116 | N/A | N/A | 471 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908389 | 82046 | 82061 | ACCTGTTTGGACTGTT | 5 | N/A | N/A | 472 |
| 908390 | 82049 | 82064 | CCAACCTGTTTGGACT | 74 | N/A | N/A | 473 |
| 908391 | 82051 | 82066 | TTCCAACCTGTTTGGA | 54 | N/A | N/A | 474 |
| 908392 | 82055 | 82070 | CGTTTTCCAACCTGTT | 3 | N/A | N/A | 475 |
| 908393 | 82069 | 82084 | GGCTCTAGGACGAGCG | 55 | N/A | N/A | 476 |
| 908394 | 82072 | 82087 | CCTGGCTCTAGGACGA | 41 | N/A | N/A | 477 |
| 908395 | 82083 | 82098 | TGTCCATGACACCTGG | 66 | N/A | N/A | 478 |
| 908396 | 82086 | 82101 | TCATGTCCATGACACC | 8 | N/A | N/A | 479 |
| 908397 | 82088 | 82103 | ATTCATGTCCATGACA | 25 | N/A | N/A | 480 |
| 908398 | 82704 | 82719 | CCCCACGGGCAGCCAC | 127 | N/A | N/A | 481 |
| 908399 | 83290 | 83305 | GGGCACCGTGGACCGG | 112 | N/A | N/A | 482 |
| 908400 | 83646<br>83734<br>83822 | 83661<br>83749<br>83837 | CATATGCAGCTGTCAG | 27 | N/A<br>N/A<br>N/A | N/A<br>N/A<br>N/A | 483 |
| 908401 | 83647<br>83735<br>83823 | 83662<br>83750<br>83838 | CCATATGCAGCTGTCA | 2 | N/A<br>N/A<br>N/A | N/A<br>N/A<br>N/A | 484 |
| 908402 | 83649<br>83737<br>83825 | 83664<br>83752<br>83840 | TGCCATATGCAGCTGT | 27 | N/A<br>N/A<br>N/A | N/A<br>N/A<br>N/A | 485 |
| 908403 | 83650<br>83738<br>83826 | 83665<br>83753<br>83841 | TTGCCATATGCAGCTG | 18 | N/A<br>N/A<br>N/A | N/A<br>N/A<br>N/A | 486 |
| 908404 | 83651<br>83739<br>83827 | 83666<br>83754<br>83842 | TTTGCCATATGCAGCT | 17 | N/A<br>N/A<br>N/A | N/A<br>N/A<br>N/A | 487 |
| 908405 | 83658<br>83746<br>83834 | 83673<br>83761<br>83849 | GGGTTACTTTGCCATA | 7 | N/A<br>N/A<br>N/A | N/A<br>N/A<br>N/A | 488 |
| 908406 | 83659<br>83747<br>83835 | 83674<br>83762<br>83850 | AGGGTTACTTTGCCAT | 74 | N/A<br>N/A<br>N/A | N/A<br>N/A<br>N/A | 489 |
| 908407 | 83660<br>83748<br>83836 | 83675<br>83763<br>83851 | AAGGGTTACTTTGCCA | 7 | N/A<br>N/A<br>N/A | N/A<br>N/A<br>N/A | 490 |
| 908408 | 83661<br>83749<br>83837 | 83676<br>83764<br>83852 | TAAGGGTTACTTTGCC | 2 | N/A<br>N/A<br>N/A | N/A<br>N/A<br>N/A | 491 |
| 908409 | 83662<br>83750<br>83838 | 83677<br>83765<br>83853 | GTAAGGGTTACTTTGC | 8 | N/A<br>N/A<br>N/A | N/A<br>N/A<br>N/A | 492 |
| 908410 | 83663<br>83751<br>83839 | 83678<br>83766<br>83854 | GGTAAGGGTTACTTTG | 12 | N/A<br>N/A<br>N/A | N/A<br>N/A<br>N/A | 493 |
| 908411 | 83664<br>83752<br>83840 | 83679<br>83767<br>83855 | AGGTAAGGGTTACTTT | 17 | N/A<br>N/A<br>N/A | N/A<br>N/A<br>N/A | 494 |
| 908412 | 83665<br>83753<br>83841 | 83680<br>83768<br>83856 | GAGGTAAGGGTTACTT | 12 | N/A<br>N/A<br>N/A | N/A<br>N/A<br>N/A | 495 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID 2: Stop Site | SEQ ID NO |
|---|---|---|---|---|---|---|---|
| 908413 | 83666 | 83681 | TGAGGTAAGGGTTACT | 3 | N/A | N/A | 496 |
|  | 83754 | 83769 |  |  | N/A | N/A |  |
|  | 83842 | 83857 |  |  | N/A | N/A |  |
| 908414 | 83667 | 83682 | TTGAGGTAAGGGTTAC | 5 | N/A | N/A | 497 |
|  | 83755 | 83770 |  |  | N/A | N/A |  |
|  | 83843 | 83858 |  |  | N/A | N/A |  |
| 908415 | 83669 | 83684 | AACCCTTACCTCAATC | 3 | N/A | N/A | 498 |
|  | 83757 | 83772 |  |  | N/A | N/A |  |
|  | 83845 | 83860 |  |  | N/A | N/A |  |
| 908416 | 83670 | 83685 | TGATTGAGGTAAGGGT | 4 | N/A | N/A | 499 |
|  | 83758 | 83773 |  |  | N/A | N/A |  |
|  | 83846 | 83861 |  |  | N/A | N/A |  |
| 908417 | 83671 | 83686 | TTGATTGAGGTAAGGG | 2 | N/A | N/A | 500 |
|  | 83759 | 83774 |  |  | N/A | N/A |  |
|  | 83847 | 83862 |  |  | N/A | N/A |  |
| 908418 | 83672 | 83687 | CTTGATTGAGGTAAGG | 8 | N/A | N/A | 501 |
|  | 83760 | 83775 |  |  | N/A | N/A |  |
|  | 83848 | 83863 |  |  | N/A | N/A |  |
| 908419 | 83673 | 83688 | TCTTGATTGAGGTAAG | 5 | N/A | N/A | 502 |
|  | 83761 | 83776 |  |  | N/A | N/A |  |
|  | 83849 | 83864 |  |  | N/A | N/A |  |
| 908420 | 83674 | 83689 | ATCTTGATTGAGGTAA | 2 | N/A | N/A | 503 |
|  | 83762 | 83777 |  |  | N/A | N/A |  |
|  | 83850 | 83865 |  |  | N/A | N/A |  |
| 908421 | 83684 | 83699 | ACCGCTCTGTATCTTG | 3 | N/A | N/A | 504 |
|  | 83772 | 83787 |  |  | N/A | N/A |  |
|  | 83860 | 83875 |  |  | N/A | N/A |  |
| 908422 | 83685 | 83700 | AACCGCTCTGTATCTT | 3 | N/A | N/A | 505 |
|  | 83773 | 83788 |  |  | N/A | N/A |  |
|  | 83861 | 83876 |  |  | N/A | N/A |  |
| 908423 | 83686 | 83701 | AGATACAGAGCGGTTC | 28 | N/A | N/A | 506 |
|  | 83774 | 83789 |  |  | N/A | N/A |  |
|  | 83862 | 83877 |  |  | N/A | N/A |  |
| 908424 | 83687 | 83702 | GGAACCGCTCTGTATC | 8 | N/A | N/A | 507 |
|  | 83775 | 83790 |  |  | N/A | N/A |  |
|  | 83863 | 83878 |  |  | N/A | N/A |  |
| 908425 | 83688 | 83703 | CGGAACCGCTCTGTAT | 13 | N/A | N/A | 508 |
|  | 83776 | 83791 |  |  | N/A | N/A |  |
|  | 83864 | 83879 |  |  | N/A | N/A |  |
| 908426 | 83689 | 83704 | ACGGAACCGCTCTGTA | 47 | N/A | N/A | 509 |
|  | 83777 | 83792 |  |  | N/A | N/A |  |
|  | 83865 | 83880 |  |  | N/A | N/A |  |
| 908427 | 83690 | 83705 | GACGGAACCGCTCTGT | 21 | N/A | N/A | 510 |
|  | 83778 | 83793 |  |  | N/A | N/A |  |
|  | 83866 | 83881 |  |  | N/A | N/A |  |
| 908428 | 83691 | 83706 | TGACGGAACCGCTCTG | 33 | N/A | N/A | 511 |
|  | 83779 | 83794 |  |  | N/A | N/A |  |
|  | 83867 | 83882 |  |  | N/A | N/A |  |
| 908429 | 83692 | 83707 | GTGACGGAACCGCTCT | 44 | N/A | N/A | 512 |
|  | 83780 | 83795 |  |  | N/A | N/A |  |
|  | 83868 | 83883 |  |  | N/A | N/A |  |
| 908430 | 83693 | 83708 | GGTGACGGAACCGCTC | 27 | N/A | N/A | 513 |
|  | 83781 | 83796 |  |  | N/A | N/A |  |
|  | 83869 | 83884 |  |  | N/A | N/A |  |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908431 | 83694 | 83709 | AGCGGTTCCGTCACCT | 67 | N/A | N/A | 514 |
|  | 83782 | 83797 |  |  | N/A | N/A |  |
|  | 83870 | 83885 |  |  | N/A | N/A |  |
| 908432 | 83695 | 83710 | GAGGTGACGGAACCGC | 69 | N/A | N/A | 515 |
|  | 83783 | 83798 |  |  | N/A | N/A |  |
|  | 83871 | 83886 |  |  | N/A | N/A |  |
| 908433 | 83696 | 83711 | GGAGGTGACGGAACCG | 62 | N/A | N/A | 516 |
|  | 83784 | 83799 |  |  | N/A | N/A |  |
|  | 83872 | 83887 |  |  | N/A | N/A |  |
| 908434 | 83697 | 83712 | AGGAGGTGACGGAACC | 6 | N/A | N/A | 517 |
|  | 83785 | 83800 |  |  | N/A | N/A |  |
|  | 83873 | 83888 |  |  | N/A | N/A |  |
| 908435 | 83698 | 83713 | TAGGAGGTGACGGAAC | 16 | N/A | N/A | 518 |
|  | 83786 | 83801 |  |  | N/A | N/A |  |
|  | 83874 | 83889 |  |  | N/A | N/A |  |
| 908436 | 83699 | 83714 | TTAGGAGGTGACGGAA | 14 | N/A | N/A | 519 |
|  | 83787 | 83802 |  |  | N/A | N/A |  |
|  | 83875 | 83890 |  |  | N/A | N/A |  |
| 908437 | 83709 | 83724 | GACAGGGATTTTAGGA | 29 | N/A | N/A | 520 |
|  | 83885 | 83900 |  |  | N/A | N/A |  |
| 908438 | 83710 | 83725 | GGACAGGGATTTTAGG | 49 | N/A | N/A | 521 |
|  | 83886 | 83901 |  |  | N/A | N/A |  |
| 908439 | 83719 | 83734 | CCTGTCCCTATCATGC | 3 | N/A | N/A | 522 |
|  | 83807 | 83822 |  |  | N/A | N/A |  |
| 908440 | 83720 | 83735 | AGCATGATAGGGACAG | 4 | N/A | N/A | 523 |
|  | 83808 | 83823 |  |  | N/A | N/A |  |
| 908441 | 83721 | 83736 | CAGCATGATAGGGACA | 2 | N/A | N/A | 524 |
|  | 83809 | 83824 |  |  | N/A | N/A |  |
| 908442 | 83722 | 83737 | TCAGCATGATAGGGAC | 4 | N/A | N/A | 525 |
|  | 83810 | 83825 |  |  | N/A | N/A |  |
| 908443 | 83723 | 83738 | GTCAGCATGATAGGGA | 4 | N/A | N/A | 526 |
|  | 83811 | 83826 |  |  | N/A | N/A |  |
| 908444 | 83724 | 83739 | TGTCAGCATGATAGGG | 4 | N/A | N/A | 527 |
|  | 83812 | 83827 |  |  | N/A | N/A |  |
| 908445 | 83725 | 83740 | CTGTCAGCATGATAGG | 44 | N/A | N/A | 528 |
|  | 83813 | 83828 |  |  | N/A | N/A |  |
| 908446 | 83726 | 83741 | GCTGTCAGCATGATAG | 70 | N/A | N/A | 529 |
|  | 83814 | 83829 |  |  | N/A | N/A |  |
| 908447 | 83727 | 83742 | TATCATGCTGACAGCT | 55 | N/A | N/A | 530 |
|  | 83815 | 83830 |  |  | N/A | N/A |  |
| 908448 | 83910 | 83925 | GAGGTTGACTACAAAG | 12 | N/A | N/A | 531 |
| 908449 | 83913 | 83928 | TGAGAGGTTGACTACA | 6 | N/A | N/A | 532 |
| 908450 | 83915 | 83930 | TTTGAGAGGTTGACTA | 17 | N/A | N/A | 533 |
| 908451 | 83921 | 83936 | TGGGTTTTGAGAGGT | 9 | N/A | N/A | 534 |
| 908452 | 84177 | 84192 | GGCGATGGCACGACCA | 71 | N/A | N/A | 535 |
| 908453 | 84938 | 84953 | GTATAAGGACGGCCCA | 45 | N/A | N/A | 536 |
| 908454 | 85500 | 85515 | TCAGATCCGGCCTGGC | 191 | N/A | N/A | 537 |
| 908455 | 86165 | 86180 | GTGGTGTGGCGTGCGC | 75 | N/A | N/A | 538 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908456 | 86583 | 86598 | GAACTTACTGTCTCCC | 14 | N/A | N/A | 539 |
| 908457 | 87056 | 87071 | AGGCAGGGCCGCTGTC | 100 | N/A | N/A | 540 |
| 908458 | 87386 | 87401 | AGGATTGGTGCCGCCC | 36 | N/A | N/A | 541 |
| 908459 | 87906 | 87921 | AATCAGCGGGTGATGC | 118 | N/A | N/A | 542 |
| 908460 | 88179 | 88194 | GCCCAGTGGCCGCCCT | 70 | N/A | N/A | 543 |
| 908461 | 88831 | 88846 | CTACAGCTGGTGCGGT | 40 | N/A | N/A | 544 |
| 908462 | 89400 | 89415 | CGCCAGGCTTGGGCCC | 100 | N/A | N/A | 545 |
| 908463 | 89711 | 89726 | GCCCAGATAAGAAGCC | 38 | N/A | N/A | 546 |
| 908464 | 90096 | 90111 | GGCTAGTTCATGCCGG | 63 | N/A | N/A | 547 |
| 908465 | 90743 | 90758 | ACGGCCTGGGCACACG | 52 | N/A | N/A | 548 |
| 908466 | 90747 | 90762 | GGAAACGGCCTGGGCA | 64 | N/A | N/A | 549 |
| 908467 | 90750 | 90765 | AAGGGAAACGGCCTGG | 76 | N/A | N/A | 550 |
| 908468 | 90753 | 90768 | CGCAAGGGAAACGGCC | 108 | N/A | N/A | 551 |
| 908469 | 90755 | 90770 | TGCGCAAGGGAAACGG | 87 | N/A | N/A | 552 |
| 908470 | 90757 | 90772 | GCTGCGCAAGGGAAAC | 124 | N/A | N/A | 553 |
| 908471 | 90761 | 90776 | CCCTTGCGCAGCTCTG | 18 | N/A | N/A | 554 |
| 908472 | 90765 | 90780 | CACACAGAGCTGCGCA | 57 | N/A | N/A | 555 |
| 908473 | 90778 | 90793 | GAAGCCCCTGCACAC | 37 | N/A | N/A | 556 |
| 908474 | 90781 | 90796 | AGAGAAGCCCCTGCA | 72 | N/A | N/A | 557 |
| 908475 | 90809 | 90824 | CCAAGTGAGCAGCCAC | 9 | N/A | N/A | 558 |
| 908476 | 90811 | 90826 | GACCAAGTGAGCAGCC | 27 | N/A | N/A | 559 |
| 908477 | 90813 | 90828 | GGGACCAAGTGAGCAG | 63 | N/A | N/A | 560 |
| 908478 | 91157 | 91172 | CACTAGGCCCTGCCAG | 128 | N/A | N/A | 561 |
| 908479 | 91836 | 91851 | GAGCGGGGTCTGTGA | 58 | N/A | N/A | 562 |
| 908480 | 92802 | 92817 | CAGCACTTTGTCCGGG | 82 | N/A | N/A | 563 |
| 908481 | 93315 | 93330 | ACCTACGGCAAGCGCA | 31 | N/A | N/A | 564 |
| 908482 | 93568 | 93583 | TACCAGGATCTCCCCC | 19 | N/A | N/A | 565 |
| 908483 | 94077 | 94092 | GCTAGAGGAGCGGCAC | 74 | N/A | N/A | 566 |
| 908484 | 94531 | 94546 | GCCCATCTCACGCCCC | 71 | N/A | N/A | 567 |
| 908485 | 95058 | 95073 | CCAGAGGCCACGGCCA | 94 | N/A | N/A | 568 |
| 908486 | 95635 | 95650 | CCGCACACCCCTCGGT | 111 | N/A | N/A | 569 |
| 908487 | 96522 | 96537 | CAGGCCGCCCTGTGCG | 93 | N/A | N/A | 570 |
| 908488 | 97096 | 97111 | CCCAAGCATTTCCAGC | 37 | N/A | N/A | 571 |
| 908489 | 97109 | 97124 | AGTTCCACCCTGTCCC | 23 | N/A | N/A | 572 |
| 908490 | 97144 | 97159 | TAGAGACACCTCCAGC | 47 | N/A | N/A | 573 |
| 908491 | 97147 | 97162 | CAATAGAGACACCTCC | 44 | N/A | N/A | 574 |
| 908492 | 97150 | 97165 | CCGCAATAGAGACACC | 43 | N/A | N/A | 575 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 908493 | 97152 | 97167 | GACCGCAATAGAGACA | 64 | N/A | N/A | 576 |
| 908494 | 97154 | 97169 | GGGACCGCAATAGAGA | 94 | N/A | N/A | 577 |
| 908495 | 97157 | 97172 | CTATTGCGGTCCCTGG | 31 | N/A | N/A | 578 |
| 908496 | 97159 | 97174 | AGCCAGGGACCGCAAT | 85 | N/A | N/A | 579 |
| 908497 | 97426 | 97441 | GCCCACCCGCTCTTCC | 80 | N/A | N/A | 580 |
| 908498 | 98041 | 98056 | TGGAACCCCGGTGCCC | 119 | N/A | N/A | 581 |
| 908499 | 98971 | 98986 | CTTCACCGTTTGGCCA | 45 | N/A | N/A | 582 |
| 908500 | 100149 | 100164 | CGCGGAGCCAGGCCCT | 114 | N/A | N/A | 583 |
| 908501 | 101337 | 101352 | CCCCAGAGTCCCGCAG | 72 | N/A | N/A | 584 |
| 908502 | 101845 | 101860 | ACACGAAGGGCCCCTC | 52 | N/A | N/A | 585 |
| 908503 | 102223 | 102238 | GCAGACTGATAGGGCC | 103 | N/A | N/A | 586 |
| 908504 | 102495 | 102510 | GGATAGCCGGCCCCGC | 102 | N/A | N/A | 587 |
| 908505 | 102955 | 102970 | CGCGGCCGGAAGCTTC | 93 | N/A | N/A | 588 |
| 908506 | 103211 103249 | 103226 103264 | CAGAGCATAGGAGAGG | 7 | N/A N/A | N/A N/A | 589 |
| 908507 | 103213 103251 | 103228 103266 | AGCAGAGCATAGGAGA | 12 | N/A N/A | N/A N/A | 590 |
| 908508 | 103216 103254 | 103231 103269 | GGGAGCAGAGCATAGG | 16 | N/A N/A | N/A N/A | 591 |
| 908509 | 104082 | 104097 | GCCAGCCACGGCTGTC | 81 | N/A | N/A | 592 |
| 908510 | 104495 | 104510 | GCTGACGGCACGCACA | 65 | N/A | N/A | 593 |
| 908511 | 105108 | 105123 | TGGGGATGGCTCGGGG | 79 | N/A | N/A | 594 |
| 908512 | 105526 | 105541 | CACCAGGGCTCCGCCT | 107 | N/A | N/A | 595 |
| 908513 | 106268 | 106283 | GGCACACGGCTCAGGG | 93 | N/A | N/A | 596 |
| 908514 | 106974 | 106989 | CAGCAAGTGGCTGCCC | 107 | N/A | N/A | 597 |
| 908515 | 107645 | 107660 | TGGGAGTGGTACTGCA | 70 | N/A | N/A | 598 |
| 908516 | 108733 | 108748 | TGCCATGGGTCTGGCA | 86 | N/A | N/A | 599 |
| 908517 | 108893 | 108908 | GCTCCTCACCTGGTCC | 92 | N/A | N/A | 600 |
| 908518 | 108899 | 108914 | AGGACGGCTCCTCACC | 111 | N/A | N/A | 601 |
| 908519 | 108902 | 108917 | GAGGAGCCGTCCTGCG | 85 | N/A | N/A | 602 |
| 908520 | 108906 | 108921 | GCTGCGCAGGACGGCT | 104 | N/A | N/A | 603 |
| 908521 | 109226 | 109241 | GGGCGAACCACCCACC | 78 | N/A | N/A | 604 |
| 908522 | 109577 | 109592 | GCCCAAAGGATCTGCC | 88 | N/A | N/A | 605 |
| 908523 | 109968 | 109983 | CCCTATTGTCCCACCA | 43 | N/A | N/A | 606 |
| 908524 | 110612 | 110627 | GTGCACTCTAGGCTTA | 100 | N/A | N/A | 607 |
| 908525 | 111378 | 111393 | GGACACAGCGGCTGCC | 78 | N/A | N/A | 608 |
| 908526 | 111925 | 111940 | CCGCAGGTTTCTGTGG | 122 | N/A | N/A | 609 |
| 908527 | 112198 | 112213 | ACCGATAGGATCGGAG | 95 | N/A | N/A | 610 |

TABLE 1-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID 2: Stop Site | SEQ ID NO |
|---|---|---|---|---|---|---|---|
| 908528 | 112578 | 112593 | GGCCGTCACAACTTTT | 116 | N/A | N/A | 611 |
| 908529 | 112910 | 112925 | CTGGAACCTCCTACTG | 87 | N/A | N/A | 612 |
| 908530 | 114292 | 114307 | GGCCGAATGCTTGAGG | 97 | N/A | N/A | 613 |
| 908531 | 114921 | 114936 | TCACAGGGCCCCCTCA | 68 | N/A | N/A | 614 |
| 908532 | 115371 | 115386 | GGCCTTACCTGGGCAC | 101 | N/A | N/A | 615 |
| 908533 | 115837 | 115852 | CCGCAAGCCACCAGGG | 87 | N/A | N/A | 616 |

*Oligos with an asterisk target an amplicon region.

Each modified oligonucleotide listed in the table below is 100% complementary to human DNM2 nucleic acid sequence GENBANK Number NM_001005361.2 (designated herein as SEQ ID NO: 3). "Start Site" indicates the 5'-most nucleoside of SEQ ID No: 3 to which the oligonucleotide is complementary. "Stop Site" indicates the 3'-most nucleoside of SEQ ID No: 3 to which the modified oligonucleotide is complementary. 'N/A' indicates that the modified oligonucleotide is not 100% complementary to the particular nucleic acid. As shown below, modified oligonucleotides complementary to DNM2 reduced human DNM2 mRNA expression.

TABLE 2

DNM2 mRNA Expression

| Compound Number | SEQ ID: 3 Start Site | SEQ ID: 3 Stop Site | Sequence | Dynamin2 (% Control) | SEQ ID NO |
|---|---|---|---|---|---|
| 695118 | 1728 | 1743 | ATCTCCCCCTGATTGG | 60 | 617 |
| 908218 | 1732 | 1747 | CAGGATCTCCCCCTGA | 114 | 618 |
| 908219 | 1379 | 1394 | GCCCCGTCCTGACTCC | 61 | 619 |
| 908220 | 1381 | 1396 | GAGCCCCGTCCTGACT | 92 | 620 |
| 908233 | 1515 | 1530 | CTGAGCTTCTCGGCAC | 70 | 621 |
| 908234 | 1517 | 1532 | AACTGAGCTTCTCGGC | 85 | 622 |
| 908235 | 1519 | 1534 | GGAACTGAGCTTCTCG | 33 | 623 |

Example 2: Effect of Modified Oligonucleotides Complementary to Dynamin 2 In Vitro Modified oligonucleotides complementary to dynamin 2 (DNM2) nucleic acid were designed and tested for their effect on dynamin 2 mRNA in vitro. The modified oligonucleotides were tested in a series of experiments that had similar culture conditions.

A431 cells cultured at a density of 10,000 cells per well were treated with 2,000 nM of modified oligonucleotide via free uptake or no oligonucleotide for untreated controls. After approximately 24 hours, RNA was isolated from the cells and DNM2 mRNA levels were measured by quantitative real-time PCR as described in Example 1.

The modified oligonucleotides in the tables below each have a 3-10-3 cEt gapmer motif, wherein the central gap segment contains ten 2'-deoxynucleosides and is flanked by wing segments on the 3' and 5' ends, each containing three cEt nucleosides. All cytosine residues throughout each modified oligonucleotide are 5-methyl cytosines. All internucleoside linkages are phosphorothioate internucleoside linkages.

Each modified oligonucleotide listed in the tables below is 100% complementary to human DNM2 nucleic acid sequence GENBANK Number NC_000019.10, truncated from 10715001 to 1083500 (SEQ ID NO: 1) and/or GENBANK Number NM_004945.3 (SEQ ID NO: 2). As shown below, modified oligonucleotides complementary to human DNM2 inhibited human DNM2 mRNA expression.

TABLE 3

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 694792 | 3060 | 3075 | CGACACCCGACCCGAG | 26 | N/A | N/A | 624 |
| 694812 | 3317 | 3332 | GTCCAGGTGGCAGCTC | 37 | 265 | 280 | 625 |
| 694826 | 57522 | 57537 | CCGGACTTCATCAAAG | 82 | 469 | 484 | 626 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 694999 | 115263 | 115278 | GTCCAGGCCGGGATGG | 92 | 2606 | N/A | 627 |
| 695015 | 116005 | 116020 | GCGGATAATGGTGGGC | 12 | 2749 | N/A | 628 |
| 695016 | 116011 | 116026 | GGCTGGGCGGATAATG | 76 | 2755 | N/A | 629 |
| 695170 | 82446 | 82461 | CTTCAAACTCGGCTCT | 9 | N/A | N/A | 630 |
| 695171 | 82451 | 82466 | ACACACTTCAAACTCG | 7 | N/A | N/A | 13 |
| 695171 | 82451 | 82466 | ACACACTTCAAACTCG | 12 | N/A | N/A | 13 |
| 695171 | 82451 | 82466 | ACACACTTCAAACTCG | 9 | N/A | N/A | 13 |
| 695171 | 82451 | 82466 | ACACACTTCAAACTCG | 8 | N/A | N/A | 13 |
| 695171 | 82451 | 82466 | ACACACTTCAAACTCG | 11 | N/A | N/A | 13 |
| 695171 | 82451 | 82466 | ACACACTTCAAACTCG | 7 | N/A | N/A | 13 |
| 695171 | 82451 | 82466 | ACACACTTCAAACTCG | 121 | N/A | N/A | 13 |
| 695171 | 82451 | 82466 | ACACACTTCAAACTCG | 14 | N/A | N/A | 13 |
| 695171 | 82451 | 82466 | ACACACTTCAAACTCG | 8 | N/A | N/A | 13 |
| 695171 | 82451 | 82466 | ACACACTTCAAACTCG | 6 | N/A | N/A | 13 |
| 695171 | 82451 | 82466 | ACACACTTCAAACTCG | 31 | N/A | N/A | 13 |
| 695171 | 82451 | 82466 | ACACACTTCAAACTCG | 8 | N/A | N/A | 13 |
| 695171 | 82451 | 82466 | ACACACTTCAAACTCG | 6 | N/A | N/A | 13 |
| 695171 | 82451 | 82466 | ACACACTTCAAACTCG | 10 | N/A | N/A | 13 |
| 695171 | 82451 | 82466 | ACACACTTCAAACTCG | 8 | N/A | N/A | 13 |
| 695171 | 82451 | 82466 | ACACACTTCAAACTCG | 12 | N/A | N/A | 13 |
| 695171 | 82451 | 82466 | ACACACTTCAAACTCG | 11 | N/A | N/A | 13 |
| 695171 | 82451 | 82466 | ACACACTTCAAACTCG | 11 | N/A | N/A | 13 |
| 695171 | 82451 | 82466 | ACACACTTCAAACTCG | 5 | N/A | N/A | 13 |
| 695171 | 82451 | 82466 | ACACACTTCAAACTCG | 12 | N/A | N/A | 13 |
| 695171 | 82451 | 82466 | ACACACTTCAAACTCG | 7 | N/A | N/A | 13 |
| 695171 | 82451 | 82466 | ACACACTTCAAACTCG | 120 | N/A | N/A | 13 |
| 695171 | 82451 | 82466 | ACACACTTCAAACTCG | 6 | N/A | N/A | 13 |
| 695171 | 82451 | 82466 | ACACACTTCAAACTCG | 8 | N/A | N/A | 13 |
| 695171 | 82451 | 82466 | ACACACTTCAAACTCG | 9 | N/A | N/A | 13 |
| 695171 | 82451 | 82466 | ACACACTTCAAACTCG | 7 | N/A | N/A | 13 |
| 695171 | 82451 | 82466 | ACACACTTCAAACTCG | 10 | N/A | N/A | 13 |
| 695171 | 82451 | 82466 | ACACACTTCAAACTCG | 9 | N/A | N/A | 13 |
| 695171 | 82451 | 82466 | ACACACTTCAAACTCG | 9 | N/A | N/A | 13 |
| 695171 | 82451 | 82466 | ACACACTTCAAACTCG | 9 | N/A | N/A | 13 |
| 695171 | 82451 | 82466 | ACACACTTCAAACTCG | 10 | N/A | N/A | 13 |
| 695171 | 82451 | 82466 | ACACACTTCAAACTCG | 7 | N/A | N/A | 13 |
| 948484 | 82379 | 82394 | GTGAAGAGCCCCGTCC | 42 | N/A | N/A | 631 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
| --- | --- | --- | --- | --- | --- | --- | --- |
| 948485 | 82380 | 82395 | GGTGAAGAGCCCCGTC | 103 | N/A | N/A | 632 |
| 948486 | 82443 | 82458 | CAAACTCGGCTCTTTG | 99 | N/A | N/A | 633 |
| 948487 | 82444 | 82459 | TCAAACTCGGCTCTTT | 15 | N/A | N/A | 634 |
| 948488 | 82445 | 82460 | TTCAAACTCGGCTCTT | 5 | N/A | N/A | 635 |
| 948489 | 82448 | 82463 | CACTTCAAACTCGGCT | 3 | N/A | N/A | 636 |
| 948490 | 82449 | 82464 | ACACTTCAAACTCGGC | 1 | N/A | N/A | 637 |
| 948491 | 82450 | 82465 | CACACTTCAAACTCGG | 25 | N/A | N/A | 638 |
| 948492 | 82452 | 82467 | AACACACTTCAAACTC | 11 | N/A | N/A | 639 |
| 948493 | 82453 | 82468 | CAACACACTTCAAACT | 51 | N/A | N/A | 640 |
| 948494 | 82454 | 82469 | TCAACACACTTCAAAC | 30 | N/A | N/A | 641 |
| 948495 | 82458 | 82473 | GAGATCAACACACTTC | 19 | N/A | N/A | 642 |
| 948496 | 82460 | 82475 | ACGAGATCAACACACT | 5 | N/A | N/A | 643 |
| 948497 | 82461 | 82476 | CACGAGATCAACACAC | 28 | N/A | N/A | 644 |
| 948498 | 82463 | 82478 | ACCACGAGATCAACAC | 50 | N/A | N/A | 645 |
| 948499 | 82467 | 82482 | TGAGACCACGAGATCA | 55 | N/A | N/A | 646 |
| 948500 | 82469 | 82484 | TCTGAGACCACGAGAT | 107 | N/A | N/A | 647 |
| 948501 | 82470 | 82485 | CTCTGAGACCACGAGA | 119 | N/A | N/A | 648 |
| 948502 | 82490 | 82505 | TTTTTTATGACCGTGG | 18 | N/A | N/A | 649 |
| 948503 | 82496 | 82511 | GCACACTTTTTTATGA | 17 | N/A | N/A | 650 |
| 948504 | 82497 | 82512 | GGCACACTTTTTTATG | 54 | N/A | N/A | 651 |
| 948505 | 82499 | 82514 | TCGGCACACTTTTTTA | 10 | N/A | N/A | 652 |
| 948506 | 82500 | 82515 | CTCGGCACACTTTTTT | 3 | N/A | N/A | 653 |
| 948507 | 82501 | 82516 | TCTCGGCACACTTTTT | 3 | N/A | N/A | 654 |
| 948508 | 82503 | 82518 | CTTCTCGGCACACTTT | 3 | N/A | N/A | 655 |
| 948514 | 3056 | 3071 | ACCCGACCCGAGCGAC | 81 | 4 | 19 | 656 |
| 948515 | 3067 | 3082 | TCTCAGGCGACACCCG | 88 | 15 | 30 | 657 |
| 948516 | 3092 | 3107 | CCTCACGGTCGCCGCC | 56 | 40 | 55 | 658 |
| 948517 | 3094 | 3109 | GGCCTCACGGTCGCCG | 98 | 42 | 57 | 659 |
| 948518 | 3103 | 3118 | TCCCGGCTCGGCCTCA | 48 | 51 | 66 | 660 |
| 948519 | 3139 | 3154 | GCTCCCCGCCCGCCCG | 71 | 87 | 102 | 661 |
| 948520 | 3141 | 3156 | TTGCTCCCCGCCCGCC | 23 | 89 | 104 | 662 |
| 948521 | 3142 | 3157 | GTTGCTCCCCGCCCGC | 10 | 90 | 105 | 663 |
| 948522 | 3143 | 3158 | CGTTGCTCCCCGCCCG | 50 | 91 | 106 | 664 |
| 948523 | 3145 | 3160 | GCCGTTGCTCCCCGCC | 53 | 93 | 108 | 665 |
| 948524 | 3147 | 3162 | TAGCCGTTGCTCCCCG | 17 | 95 | 110 | 666 |
| 948525 | 3148 | 3163 | GTAGCCGTTGCTCCCC | 14 | 96 | 111 | 667 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948526 | 3150 | 3165 | CTGTAGCCGTTGCTCC | 10 | 98 | 113 | 668 |
| 948527 | 3151 | 3166 | TCTGTAGCCGTTGCTC | 9 | 99 | 114 | 669 |
| 948528 | 3152 | 3167 | GTCTGTAGCCGTTGCT | 13 | 100 | 115 | 670 |
| 948529 | 3168 | 3183 | GACCTGGCCCCGCGGC | 76 | 116 | 131 | 671 |
| 948530 | 3169 | 3184 | CGACCTGGCCCCGCGG | 83 | 117 | 132 | 672 |
| 948531 | 3170 | 3185 | ACGACCTGGCCCCGCG | 36 | 118 | 133 | 673 |
| 948532 | 3172 | 3187 | CAACGACCTGGCCCCG | 17 | 120 | 135 | 674 |
| 948533 | 3173 | 3188 | TCAACGACCTGGCCCC | 20 | 121 | 136 | 675 |
| 948534 | 3174 | 3189 | CTCAACGACCTGGCCC | 30 | 122 | 137 | 676 |
| 948535 | 3175 | 3190 | CCTCAACGACCTGGCC | 101 | 123 | 138 | 677 |
| 948536 | 3176 | 3191 | CCCTCAACGACCTGGC | 57 | 124 | 139 | 678 |
| 948537 | 3278 | 3293 | CTGCAGTTTGTTGACC | 45 | 226 | 241 | 679 |
| 948538 | 3299 | 3314 | GCCGATGGAGCTGAAG | 7 | 247 | 262 | 680 |
| 948539 | 3300 | 3315 | GGCCGATGGAGCTGAA | 104 | 248 | 263 | 681 |
| 948540 | N/A | N/A | AAGGAAGTCCCGGCCC | 81 | 346 | 361 | 682 |
| 948541 | N/A | N/A | GAAGGAAGTCCCGGCC | 101 | 347 | 362 | 683 |
| 948542 | 44750 | 44765 | GATTCCTGAACCGCGG | 106 | 364 | 379 | 684 |
| 948543 | 44752 | 44767 | ACGATTCCTGAACCGC | 38 | 366 | 381 | 685 |
| 948544 | 44754 | 44769 | TGACGATTCCTGAACC | 18 | 368 | 383 | 686 |
| 948545 | 44755 | 44770 | GTGACGATTCCTGAAC | 40 | 369 | 384 | 687 |
| 948546 | 44756 | 44771 | GGTGACGATTCCTGAA | 42 | 370 | 385 | 688 |
| 948547 | 44758 | 44773 | CGGGTGACGATTCCTG | 111 | 372 | 387 | 689 |
| 948548 | 44761 | 44776 | CGCCGGGTGACGATTC | 44 | 375 | 390 | 690 |
| 948549 | 44769 | 44784 | TGAGAGGCCGCCGGGT | 11 | 383 | 398 | 691 |
| 948550 | 44771 | 44786 | AATGAGAGGCCGCCGG | 76 | 385 | 400 | 692 |
| 948551 | 44772 | 44787 | GAATGAGAGGCCGCCG | 67 | 386 | 401 | 693 |
| 948552 | 44775 | 44790 | GCAGAATGAGAGGCCG | 99 | 389 | 404 | 694 |
| 948553 | 57480 | 57495 | CAAAAACTCGGCATGT | 20 | 427 | 442 | 695 |
| 948554 | 57481 | 57496 | GCAAAAACTCGGCATG | 15 | 428 | 443 | 696 |
| 948555 | 57490 | 57505 | ACTTGCAGTGCAAAAA | 15 | 437 | 452 | 697 |
| 948556 | 57492 | 57507 | GGACTTGCAGTGCAAA | 7 | 439 | 454 | 698 |
| 948557 | 57494 | 57509 | TTGGACTTGCAGTGCA | 3 | 441 | 456 | 699 |
| 948558 | 57497 | 57512 | TTTTTGGACTTGCAGT | 10 | 444 | 459 | 700 |
| 948559 | 57498 | 57513 | CTTTTTGGACTTGCAG | 6 | 445 | 460 | 701 |
| 948560 | 57500 | 57515 | AACTTTTTGGACTTGC | 3 | 447 | 462 | 702 |
| 948561 | 57501 | 57516 | AAACTTTTTGGACTTG | 92 | 448 | 463 | 703 |
| 948562 | 57502 | 57517 | TAAACTTTTTGGACTT | 8 | 449 | 464 | 704 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948563 | 57503 | 57518 | GTAAACTTTTTGGACT | 26 | 450 | 465 | 705 |
| 948564 | 57504 | 57519 | TGTAAACTTTTTGGAC | 15 | 451 | 466 | 706 |
| 948565 | 57524 | 57539 | TGCCGGACTTCATCAA | 31 | 471 | 486 | 707 |
| 948566 | 57525 | 57540 | CTGCCGGACTTCATCA | 24 | 472 | 487 | 708 |
| 948567 | 57527 | 57542 | TCCTGCCGGACTTCAT | 26 | 474 | 489 | 709 |
| 948568 | 57530 | 57545 | ATCTCCTGCCGGACTT | 14 | 477 | 492 | 710 |
| 948569 | 57531 | 57546 | AATCTCCTGCCGGACT | 18 | 478 | 493 | 711 |
| 948570 | 57535 | 57550 | CTTCAATCTCCTGCCG | 29 | 482 | 497 | 712 |
| 948571 | 57597 | 57612 | TCGAAGGTTGATGGGC | 89 | 544 | 559 | 713 |
| 948572 | 57598 | 57613 | CTCGAAGGTTGATGGG | 88 | 545 | 560 | 714 |
| 948573 | 57599 | 57614 | ACTCGAAGGTTGATGG | 75 | 546 | 561 | 715 |
| 948574 | 60706 | 60721 | ATGAGGGTCAAGTTCA | 52 | 579 | 594 | 716 |
| 948575 | 60708 | 60723 | CGATGAGGGTCAAGTT | 15 | 581 | 596 | 717 |
| 948576 | 60709 | 60724 | TCGATGAGGGTCAAGT | 28 | 582 | 597 | 718 |
| 948577 | 60710 | 60725 | GTCGATGAGGGTCAAG | 22 | 583 | 598 | 719 |
| 948578 | 60712 | 60727 | AGGTCGATGAGGGTCA | 15 | 585 | 600 | 720 |
| 948579 | 60714 | 60729 | GGAGGTCGATGAGGGT | 53 | 587 | 602 | 721 |
| 948580 | 60717 | 60732 | CCGGGAGGTCGATGAG | 93 | 590 | 605 | 722 |
| 948581 | 60721 | 60736 | ATACCCGGGAGGTCGA | 32 | 594 | 609 | 723 |
| 948582 | 60723 | 60738 | TGATACCCGGGAGGTC | 34 | 596 | 611 | 724 |
| 948583 | 60725 | 60740 | GGTGATACCCGGGAGG | 32 | 598 | 613 | 725 |
| 948584 | 60726 | 60741 | TGGTGATACCCGGGAG | 79 | 599 | 614 | 726 |
| 948585 | 60727 | 60742 | TTGGTGATACCCGGGA | 27 | 600 | 615 | 727 |
| 948586 | 60729 | 60744 | CCTTGGTGATACCCGG | 44 | 602 | 617 | 728 |
| 948587 | 60774 | 60789 | CCTTGATCTGGTACTC | 6 | 647 | 662 | 729 |
| 948588 | 60775 | 60790 | TCCTTGATCTGGTACT | 20 | 648 | 663 | 730 |
| 948589 | 60777 | 60792 | TGTCCTTGATCTGGTA | 12 | 650 | 665 | 731 |
| 948590 | 60779 | 60794 | CATGTCCTTGATCTGG | 13 | 652 | 667 | 732 |
| 948591 | 60781 | 60796 | ATCATGTCCTTGATCT | 34 | 654 | 669 | 733 |
| 948592 | 60782 | 60797 | GATCATGTCCTTGATC | 57 | 655 | 670 | 734 |
| 948593 | 60783 | 60798 | GGATCATGTCCTTGAT | 38 | 656 | 671 | 735 |
| 948594 | 60815 | 60830 | AATGAGGCTGCTCTCC | 42 | 688 | 703 | 736 |
| 948595 | 60820 | 60835 | GCCAGAATGAGGCTGC | 92 | 693 | 708 | 737 |
| 948596 | 60848 | 60863 | GGCCAGGTCCATGTTG | 92 | 721 | 736 | 738 |
| 948597 | N/A | N/A | GGTCCGTAGGCCTTGG | 45 | 775 | 790 | 739 |
| 948598 | 62120 | 62135 | CACCGATGGTCCGTAG | 49 | 782 | 797 | 740 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948599 | 62192 | 62207 | ACGGGAGCAACTTGTT | 76 | 854 | 869 | 741 |
| 948600 | 62196 | 62211 | CTCAACGGGAGCAACT | 48 | 858 | 873 | 742 |
| 948601 | 62197 | 62212 | TCTCAACGGGAGCAAC | 45 | 859 | 874 | 743 |
| 948602 | 68004 | 68019 | CACGGATGTCCTTCTT | 8 | 923 | 938 | 744 |
| 948603 | 68006 | 68021 | TGCACGGATGTCCTTC | 25 | 925 | 940 | 745 |
| 948604 | 68007 | 68022 | CTGCACGGATGTCCTT | 5 | 926 | 941 | 746 |
| 948605 | 68009 | 68024 | TGCTGCACGGATGTCC | 16 | 928 | 943 | 747 |
| 948606 | 68010 | 68025 | GTGCTGCACGGATGTC | 20 | 929 | 944 | 748 |
| 948607 | 68011 | 68026 | AGTGCTGCACGGATGT | 22 | 930 | 945 | 749 |
| 948608 | 68012 | 68027 | CAGTGCTGCACGGATG | 8 | 931 | 946 | 750 |
| 948609 | 68014 | 68029 | GCCAGTGCTGCACGGA | 37 | 933 | 948 | 751 |
| 948610 | 68015 | 68030 | TGCCAGTGCTGCACGG | 50 | 934 | 949 | 752 |
| 948611 | 68016 | 68031 | CTGCCAGTGCTGCACG | 27 | 935 | 950 | 753 |
| 948612 | 68018 | 68033 | AGCTGCCAGTGCTGCA | 107 | 937 | 952 | 754 |
| 948613 | 68056 | 68071 | TGCCGGTAGGCCGGGT | 122 | 975 | 990 | 755 |
| 948614 | 71653 | 71668 | CCGAAAGTTCTTGTAC | 31 | 1129 | 1144 | 756 |
| 948615 | 71656 | 71671 | GGGCCGAAAGTTCTTG | 88 | 1132 | 1147 | 757 |
| 948616 | 71657 | 71672 | CGGGCCGAAAGTTCTT | 75 | 1133 | 1148 | 758 |
| 948617 | 71658 | 71673 | TCGGGCCGAAAGTTCT | 42 | 1134 | 1149 | 759 |
| 948618 | 71660 | 71675 | CGTCGGGCCGAAAGTT | 20 | 1136 | 1151 | 760 |
| 948619 | 71683 | 71698 | GGCTTTGGTTTTGCGG | 80 | 1159 | 1174 | 761 |
| 948620 | 78729 | 78744 | ATCCACCCCAAACTGC | 45 | 1192 | 1207 | 762 |
| 948621 | 78771 | 78786 | AGTGTCCACCTGATCT | 27 | 1234 | 1249 | 763 |
| 948622 | 78773 | 78788 | AGAGTGTCCACCTGAT | 11 | 1236 | 1251 | 764 |
| 948623 | 78774 | 78789 | CAGAGTGTCCACCTGA | 88 | 1237 | 1252 | 765 |
| 948624 | 78775 | 78790 | CCAGAGTGTCCACCTG | 74 | 1238 | 1253 | 766 |
| 948625 | 78777 | 78792 | CTCCAGAGTGTCCACC | 51 | 1240 | 1255 | 767 |
| 948626 | 78785 | 78800 | CCGGAGAGCTCCAGAG | 98 | 1248 | 1263 | 768 |
| 948627 | 78787 | 78802 | CCCCGGAGAGCTCCAG | 44 | 1250 | 1265 | 769 |
| 948628 | 78805 | 78820 | TGCGATTGATTCGGGC | 11 | 1268 | 1283 | 770 |
| 948629 | 78806 | 78821 | ATGCGATTGATTCGGG | 3 | 1269 | 1284 | 771 |
| 948630 | 78810 | 78825 | GAAGATGCGATTGATT | 10 | 1273 | 1288 | 772 |
| 948631 | 78811 | 78826 | GGAAGATGCGATTGAT | 3 | 1274 | 1289 | 773 |
| 948632 | 78812 | 78827 | TGGAAGATGCGATTGA | 9 | 1275 | 1290 | 774 |
| 948633 | 78813 | 78828 | GTGGAAGATGCGATTG | 8 | 1276 | 1291 | 775 |
| 948634 | 78829 | 78844 | CAAATGGGAACCGCTC | 60 | 1292 | 1307 | 776 |
| 948635 | 78830 | 78845 | TCAAATGGGAACCGCT | 65 | 1293 | 1308 | 777 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948636 | 78831 | 78846 | CTCAAATGGGAACCGC | 81 | 1294 | 1309 | 778 |
| 948637 | 78832 | 78847 | GCTCAAATGGGAACCG | 58 | 1295 | 1310 | 779 |
| 948638 | 78833 | 78848 | AGCTCAAATGGGAACC | 43 | 1296 | 1311 | 780 |
| 948639 | 78837 | 78852 | CACCAGCTCAAATGGG | 70 | 1300 | 1315 | 781 |
| 948640 | 80420 | 80435 | CTCCATGGATGTTCTT | 42 | 1367 | 1382 | 782 |
| 948641 | 81059 | 81074 | TGAAAAGCCCGGTCCT | 38 | 1385 | 1400 | 783 |
| 948642 | 81060 | 81075 | GTGAAAAGCCCGGTCC | 37 | 1386 | 1401 | 784 |
| 948643 | 81062 | 81077 | GGGTGAAAAGCCCGGT | 120 | 1388 | 1403 | 785 |
| 948644 | 81077 | 81092 | CGAATGCCAAGTCCGG | 84 | 1403 | 1418 | 786 |
| 948645 | 81078 | 81093 | TCGAATGCCAAGTCCG | 28 | 1404 | 1419 | 787 |
| 948646 | 81080 | 81095 | CCTCGAATGCCAAGTC | 13 | 1406 | 1421 | 788 |
| 948647 | 81081 | 81096 | GCCTCGAATGCCAAGT | 73 | 1407 | 1422 | 789 |
| 948648 | 81084 | 81099 | ATGGCCTCGAATGCCA | 94 | 1410 | 1425 | 790 |
| 948649 | 81088 | 81103 | CACAATGGCCTCGAAT | 35 | 1414 | 1429 | 791 |
| 948650 | 81104 | 81119 | TGACGACCTGCTTTTT | 15 | 1430 | 1445 | 792 |
| 948651 | 81105 | 81120 | TTGACGACCTGCTTTT | 21 | 1431 | 1446 | 793 |
| 948652 | 81108 | 81123 | AGCTTGACGACCTGCT | 84 | 1434 | 1449 | 794 |
| 948653 | 81110 | 81125 | TCAGCTTGACGACCTG | 61 | 1436 | 1451 | 795 |
| 948654 | 81112 | 81127 | TTTCAGCTTGACGACC | 11 | 1438 | 1453 | 796 |
| 948655 | 81114 | 81129 | TCTTTCAGCTTGACGA | 27 | 1440 | 1455 | 797 |
| 948656 | 81116 | 81131 | GCTCTTTCAGCTTGAC | 3 | 1442 | 1457 | 798 |
| 948657 | 81117 | 81132 | GGCTCTTTCAGCTTGA | 59 | 1443 | 1458 | 799 |
| 948658 | 81118 | 81133 | GGGCTCTTTCAGCTTG | 73 | 1444 | 1459 | 800 |
| 948659 | 81120 | 81135 | CAGGGCTCTTTCAGCT | 75 | 1446 | 1461 | 801 |
| 948660 | 81132 | 81147 | ACACATTTCAGACAGG | 3 | 1458 | 1473 | 802 |
| 948661 | 81134 | 81149 | CGACACATTTCAGACA | 7 | 1460 | 1475 | 803 |
| 948662 | 81135 | 81150 | TCGACACATTTCAGAC | 10 | 1461 | 1476 | 804 |
| 948663 | 81136 | 81151 | GTCGACACATTTCAGA | 51 | 1462 | 1477 | 805 |
| 948664 | 81138 | 81153 | AGGTCGACACATTTCA | 3 | 1464 | 1479 | 806 |
| 948665 | 81140 | 81155 | CCAGGTCGACACATTT | 6 | 1466 | 1481 | 807 |
| 948666 | 81141 | 81156 | ACCAGGTCGACACATT | 8 | 1467 | 1482 | 808 |
| 948667 | 81142 | 81157 | AACCAGGTCGACACAT | 34 | 1468 | 1483 | 809 |
| 948668 | 81146 | 81161 | GGATAACCAGGTCGAC | 34 | 1472 | 1487 | 810 |
| 948669 | 81148 | 81163 | CTGGATAACCAGGTCG | 43 | 1474 | 1489 | 811 |
| 948670 | 81149 | 81164 | CCTGGATAACCAGGTC | 111 | 1475 | 1490 | 812 |
| 948671 | 81150 | 81165 | TCCTGGATAACCAGGT | 100 | 1476 | 1491 | 813 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948672 | 81152 | 81167 | GCTCCTGGATAACCAG | 51 | 1478 | 1493 | 814 |
| 948673 | 81159 | 81174 | TTGATTAGCTCCTGGA | 2 | 1485 | 1500 | 815 |
| 948674 | 81161 | 81176 | TATTGATTAGCTCCTG | 8 | 1487 | 1502 | 816 |
| 948675 | 81162 | 81177 | GTATTGATTAGCTCCT | 2 | 1488 | 1503 | 817 |
| 948676 | 81163 | 81178 | TGTATTGATTAGCTCC | 1 | 1489 | 1504 | 818 |
| 948677 | 81164 | 81179 | CTGTATTGATTAGCTC | 2 | 1490 | 1505 | 819 |
| 948678 | 81165 | 81180 | ACTGTATTGATTAGCT | 7 | 1491 | 1506 | 820 |
| 948679 | 81168 | 81183 | CTAACTGTATTGATTA | 56 | 1494 | 1509 | 821 |
| 948680 | 81169 | 81184 | CCTAACTGTATTGATT | 44 | 1495 | 1510 | 822 |
| 948681 | 81171 | 81186 | TGCCTAACTGTATTGA | 25 | 1497 | 1512 | 823 |
| 948682 | 81177 | 81192 | GTACACTGCCTAACTG | 23 | 1503 | 1518 | 824 |
| 948683 | 81180 | 81195 | CTGGTACACTGCCTAA | 14 | 1506 | 1521 | 825 |
| 948684 | 81181 | 81196 | ACTGGTACACTGCCTA | 8 | 1507 | 1522 | 826 |
| 948685 | 81183 | 81198 | TTACTGGTACACTGCC | 2 | 1509 | 1524 | 827 |
| 948686 | 81184 | 81199 | CTTACTGGTACACTGC | 1 | 1510 | 1525 | 828 |
| 948687 | N/A | N/A | GCTTACTGGTACACTG | 6 | 1511 | 1526 | 829 |
| 948688 | N/A | N/A | AGCTTACTGGTACACT | 26 | 1512 | 1527 | 830 |
| 948689 | N/A | N/A | GAGCTTACTGGTACAC | 12 | 1513 | 1528 | 831 |
| 948690 | N/A | N/A | ACTGAGCTTACTGGTA | 47 | 1516 | 1531 | 832 |
| 948691 | N/A | N/A | AACTGAGCTTACTGGT | 24 | 1517 | 1532 | 833 |
| 948692 | N/A | N/A | GGAACTGAGCTTACTG | 10 | 1519 | 1534 | 834 |
| 948693 | N/A | N/A | AGGAACTGAGCTTACT | 12 | 1520 | 1535 | 835 |
| 948694 | N/A | N/A | TAGGAACTGAGCTTAC | 17 | 1521 | 1536 | 836 |
| 948695 | N/A | N/A | GTAGGAACTGAGCTTA | 15 | 1522 | 1537 | 837 |
| 948696 | 83484 | 83499 | GGGTAGGAACTGAGCT | 28 | 1524 | 1539 | 838 |
| 948697 | 83500 | 83515 | CTCCTCTCGCAACCGG | 56 | 1540 | 1555 | 839 |
| 948698 | 83503 | 83518 | TGTCTCCTCTCGCAAC | 44 | 1543 | 1558 | 840 |
| 948699 | 83504 | 83519 | CTGTCTCCTCTCGCAA | 27 | 1544 | 1559 | 841 |
| 948700 | 83506 | 83521 | CTCTGTCTCCTCTCGC | 5 | 1546 | 1561 | 842 |
| 948701 | 83507 | 83522 | GCTCTGTCTCCTCTCG | 8 | 1547 | 1562 | 843 |
| 948702 | 83508 | 83523 | CGCTCTGTCTCCTCTC | 5 | 1548 | 1563 | 844 |
| 948703 | 83510 | 83525 | TTCGCTCTGTCTCCTC | 5 | 1550 | 1565 | 845 |
| 948704 | 83514 | 83529 | ACGATTCGCTCTGTCT | 69 | 1554 | 1569 | 846 |
| 948705 | 83515 | 83530 | GACGATTCGCTCTGTC | 91 | 1555 | 1570 | 847 |
| 948706 | 83516 | 83531 | TGACGATTCGCTCTGT | 37 | 1556 | 1571 | 848 |
| 948707 | 83521 | 83536 | AGTGGTGACGATTCGC | 5 | 1561 | 1576 | 849 |
| 948708 | 83523 | 83538 | TAAGTGGTGACGATTC | 25 | 1563 | 1578 | 850 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948709 | 83525 | 83540 | TGTAAGTGGTGACGAT | 21 | 1565 | 1580 | 851 |
| 948710 | 83526 | 83541 | ATGTAAGTGGTGACGA | 27 | 1566 | 1581 | 852 |
| 948711 | 83527 | 83542 | GATGTAAGTGGTGACG | 37 | 1567 | 1582 | 853 |
| 948712 | 83530 | 83545 | CCGGATGTAAGTGGTG | 60 | 1570 | 1585 | 854 |
| 948713 | 83543 | 83558 | TCCCCTCCCGTTCCCG | 40 | 1583 | 1598 | 855 |
| 948714 | 83545 | 83560 | TCTCCCCTCCCGTTCC | 30 | 1585 | 1600 | 856 |
| 948715 | 83546 | 83561 | TTCTCCCCTCCCGTTC | 43 | 1586 | 1601 | 857 |
| 948716 | 83547 | 83562 | GTTCTCCCCTCCCGTT | 14 | 1587 | 1602 | 858 |
| 948717 | N/A | N/A | GCAGAAGAATCTGGTC | 27 | 1607 | 1622 | 859 |
| 948718 | 87287 | 87302 | GATCAGCAGAAGAATC | 126 | 1612 | 1627 | 860 |
| 948719 | 87289 | 87304 | TCGATCAGCAGAAGAA | 70 | 1614 | 1629 | 861 |
| 948720 | 87291 | 87306 | TGTCGATCAGCAGAAG | 27 | 1616 | 1631 | 862 |
| 948721 | 87292 | 87307 | ATGTCGATCAGCAGAA | 51 | 1617 | 1632 | 863 |
| 948722 | 87293 | 87308 | AATGTCGATCAGCAGA | 41 | 1618 | 1633 | 864 |
| 948723 | 87295 | 87310 | TCAATGTCGATCAGCA | 17 | 1620 | 1635 | 865 |
| 948724 | 87297 | 87312 | GCTCAATGTCGATCAG | 14 | 1622 | 1637 | 866 |
| 948725 | 87298 | 87313 | TGCTCAATGTCGATCA | 41 | 1623 | 1638 | 867 |
| 948726 | 87301 | 87316 | GACTGCTCAATGTCGA | 91 | 1626 | 1641 | 868 |
| 948727 | 87303 | 87318 | AGGACTGCTCAATGTC | 28 | 1628 | 1643 | 869 |
| 948728 | 87305 | 87320 | GTAGGACTGCTCAATG | 136 | 1630 | 1645 | 870 |
| 948729 | 87306 | 87321 | TGTAGGACTGCTCAAT | 2 | 1631 | 1646 | 871 |
| 948730 | 87307 | 87322 | ATGTAGGACTGCTCAA | 18 | 1632 | 1647 | 872 |
| 948731 | 87309 | 87324 | TGATGTAGGACTGCTC | 6 | 1634 | 1649 | 873 |
| 948732 | 87310 | 87325 | TTGATGTAGGACTGCT | 13 | 1635 | 1650 | 874 |
| 948733 | 87312 | 87327 | TGTTGATGTAGGACTG | 39 | 1637 | 1652 | 875 |
| 948734 | 87313 | 87328 | GTGTTGATGTAGGACT | 22 | 1638 | 1653 | 876 |
| 948735 | 87314 | 87329 | CGTGTTGATGTAGGAC | 3 | 1639 | 1654 | 877 |
| 948736 | N/A | N/A | GGCATTGGCAAACCCG | 106 | 1672 | 1687 | 878 |
| 948737 | 97293 | 97308 | CATCAGGCTGATGTTG | 43 | 1765 | 1780 | 879 |
| 948738 | 97296 | 97311 | TTTCATCAGGCTGATG | 90 | 1768 | 1783 | 880 |
| 948739 | 97340 | 97355 | AGTGACTCGGCAGTCA | 100 | 1812 | 1827 | 881 |
| 948740 | 97342 | 97357 | ACAGTGACTCGGCAGT | 25 | 1814 | 1829 | 882 |
| 948741 | 97343 | 97358 | GACAGTGACTCGGCAG | 13 | 1815 | 1830 | 883 |
| 948742 | 97344 | 97359 | GGACAGTGACTCGGCA | 33 | 1816 | 1831 | 884 |
| 948743 | 97346 | 97361 | CAGGACAGTGACTCGG | 23 | 1818 | 1833 | 885 |
| 948744 | 97347 | 97362 | CCAGGACAGTGACTCG | 36 | 1819 | 1834 | 886 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948745 | 97348 | 97363 | ACCAGGACAGTGACTC | 23 | 1820 | 1835 | 887 |
| 948746 | 97349 | 97364 | TACCAGGACAGTGACT | 93 | 1821 | 1836 | 888 |
| 948747 | 105014 | 105029 | TCACGGATCTTGAGGT | 27 | 1884 | 1899 | 889 |
| 948748 | 105016 | 105031 | CATCACGGATCTTGAG | 52 | 1886 | 1901 | 890 |
| 948749 | 105017 | 105032 | ACATCACGGATCTTGA | 43 | 1887 | 1902 | 891 |
| 948750 | 105018 | 105033 | CACATCACGGATCTTG | 19 | 1888 | 1903 | 892 |
| 948751 | 105021 | 105036 | CTCCACATCACGGATC | 60 | 1891 | 1906 | 893 |
| 948752 | 105024 | 105039 | CTTCTCCACATCACGG | 4 | 1894 | 1909 | 894 |
| 948753 | 105061 | 105076 | TGAAGATGGCGAAGAC | 52 | 1931 | 1946 | 895 |
| 948754 | 105062 | 105077 | TTGAAGATGGCGAAGA | 101 | 1932 | 1947 | 896 |
| 948755 | 105063 | 105078 | GTTGAAGATGGCGAAG | 83 | 1933 | 1948 | 897 |
| 948756 | 108794 | 108809 | CCGCAGGTCCTTGTAG | 60 | 1966 | 1981 | 898 |
| 948757 | 108796 | 108811 | TGCCGCAGGTCCTTGT | 42 | 1968 | 1983 | 899 |
| 948758 | 108809 | 108824 | GGCCAGCTCGATCTGC | 85 | 1981 | 1996 | 900 |
| 948759 | 108855 | 108870 | GGAGGAACGAGGCCTT | 80 | 2027 | 2042 | 901 |
| 948760 | 108856 | 108871 | CGGAGGAACGAGGCCT | 107 | 2028 | 2043 | 902 |
| 948761 | 108858 | 108873 | CTCGGAGGAACGAGGC | 111 | 2030 | 2045 | 903 |
| 948762 | 108864 | 108879 | CGCCAGCTCGGAGGAA | 125 | 2036 | 2051 | 904 |
| 948763 | 110079 | 110094 | GAGAAGGTGTTCTCCT | 98 | 2094 | 2109 | 905 |
| 948764 | 110082 | 110097 | ATGGAGAAGGTGTTCT | 112 | 2097 | 2112 | 906 |
| 948765 | 110158 | 110173 | GGACTTGTTGATGATG | 9 | 2173 | 2188 | 907 |
| 948766 | 110159 | 110174 | TGGACTTGTTGATGAT | 10 | 2174 | 2189 | 908 |
| 948767 | 110161 | 110176 | GATGGACTTGTTGATG | 12 | 2176 | 2191 | 909 |
| 948768 | 110162 | 110177 | GGATGGACTTGTTGAT | 8 | 2177 | 2192 | 910 |
| 948769 | 110163 | 110178 | CGGATGGACTTGTTGA | 10 | 2178 | 2193 | 911 |
| 948770 | 110164 | 110179 | GCGGATGGACTTGTTG | 36 | 2179 | 2194 | 912 |
| 948771 | 110165 | 110180 | CGCGGATGGACTTGTT | 78 | 2180 | 2195 | 913 |
| 948772 | 110173 | 110188 | CATGAGGTCGCGGATG | 25 | 2188 | 2203 | 914 |
| 948773 | 110174 | 110189 | GCATGAGGTCGCGGAT | 4 | 2189 | 2204 | 915 |
| 948774 | 110176 | 110191 | TGGCATGAGGTCGCGG | 9 | 2191 | 2206 | 916 |
| 948775 | 114037 | 114052 | TGGATGAAGGCCTTCG | 6 | 2238 | 2253 | 917 |
| 948776 | 114065 | 114080 | GGAGTATAGGTAGGCC | 15 | 2266 | 2281 | 918 |
| 948777 | 114067 | 114082 | GAGGAGTATAGGTAGG | 7 | 2268 | 2283 | 919 |
| 948778 | 114070 | 114085 | GCCGAGGAGTATAGGT | 51 | 2271 | 2286 | 920 |
| 948779 | 114071 | 114086 | TGCCGAGGAGTATAGG | 17 | 2272 | 2287 | 921 |
| 948780 | 114152 | 114167 | CTTGAGGGCATGGTAC | 48 | 2353 | 2368 | 922 |
| 948781 | 114225 | 114240 | TGTCATCGACAGGCGG | 32 | 2426 | 2441 | 923 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948782 | 115139 | 115154 | GGACACCGGTCGGCGC | 103 | 2482 | 2497 | 924 |
| 948783 | 115140 | 115155 | TGGACACCGGTCGGCG | 43 | 2483 | 2498 | 925 |
| 948784 | 115145 | 115160 | TATGCTGGACACCGGT | 33 | 2488 | 2503 | 926 |
| 948785 | 115147 | 115162 | TGTATGCTGGACACCG | 22 | 2490 | 2505 | 927 |
| 948786 | 115148 | 115163 | GTGTATGCTGGACACC | 78 | 2491 | 2506 | 928 |
| 948787 | 115149 | 115164 | GGTGTATGCTGGACAC | 79 | 2492 | 2507 | 929 |
| 948788 | 115212 | 115227 | CGGGAACAGGAATCAG | 13 | 2555 | 2570 | 930 |
| 948789 | 115213 | 115228 | ACGGGAACAGGAATCA | 19 | 2556 | 2571 | 931 |
| 948790 | 115217 | 115232 | CCCCACGGGAACAGGA | 101 | 2560 | 2575 | 932 |
| 948791 | 115235 | 115250 | CGAGAAGGAGGCTGCT | 45 | 2578 | 2593 | 933 |
| 948792 | 115236 | 115251 | CCGAGAAGGAGGCTGC | 37 | 2579 | 2594 | 934 |
| 948793 | 115237 | 115252 | GCCGAGAAGGAGGCTG | 124 | 2580 | 2595 | 935 |
| 948794 | 115279 | 115294 | GCAAACACGCTCTGGG | 6 | 2622 | 2637 | 936 |
| 948795 | 115280 | 115295 | GGCAAACACGCTCTGG | 11 | 2623 | 2638 | 937 |
| 948796 | 115281 | 115296 | TGGCAAACACGCTCTG | 31 | 2624 | 2639 | 938 |
| 948797 | 115282 | 115297 | TTGGCAAACACGCTCT | 23 | 2625 | 2640 | 939 |
| 948798 | 115284 | 115299 | TGTTGGCAAACACGCT | 15 | 2627 | 2642 | 940 |
| 948799 | 115286 | 115301 | ACTGTTGGCAAACACG | 66 | 2629 | 2644 | 941 |
| 948800 | 115287 | 115302 | CACTGTTGGCAAACAC | 39 | 2630 | 2645 | 942 |
| 948801 | 115288 | 115303 | TCACTGTTGGCAAACA | 28 | 2631 | 2646 | 943 |
| 948802 | 115289 | 115304 | GTCACTGTTGGCAAAC | 17 | 2632 | 2647 | 944 |
| 948803 | 115290 | 115305 | GGTCACTGTTGGCAAA | 16 | 2633 | 2648 | 945 |
| 948804 | 115291 | 115306 | AGGTCACTGTTGGCAA | 9 | 2634 | 2649 | 946 |
| 948805 | 115293 | 115308 | AGAGGTCACTGTTGGC | 3 | 2636 | 2651 | 947 |
| 948806 | 115294 | 115309 | AAGAGGTCACTGTTGG | 7 | 2637 | 2652 | 948 |
| 948807 | 115295 | 115310 | GAAGAGGTCACTGTTG | 19 | 2638 | 2653 | 949 |
| 948808 | 115297 | 115312 | GGGAAGAGGTCACTGT | 13 | 2640 | 2655 | 950 |
| 948809 | 115321 | 115336 | CGAGATGGGATCTGAG | 33 | 2664 | 2679 | 951 |
| 948810 | 115322 | 115337 | CCGAGATGGGATCTGA | 18 | 2665 | 2680 | 952 |
| 948811 | 115323 | 115338 | GCCGAGATGGGATCTG | 28 | 2666 | 2681 | 953 |
| 948812 | 115327 | 115342 | ACTGGCCGAGATGGGA | 13 | 2670 | 2685 | 954 |
| 948813 | 115328 | 115343 | AACTGGCCGAGATGGG | 20 | 2671 | 2686 | 955 |
| 948814 | 115330 | 115345 | CGAACTGGCCGAGATG | 27 | 2673 | 2688 | 956 |
| 948815 | 115331 | 115346 | CCGAACTGGCCGAGAT | 46 | 2674 | 2689 | 957 |
| 948816 | 115333 | 115348 | ATCCGAACTGGCCGAG | 35 | 2676 | 2691 | 958 |
| 948817 | 115334 | 115349 | GATCCGAACTGGCCGA | 105 | 2677 | 2692 | 959 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948818 | 115991 | 116006 | GCCGGCTGGGCGCAGC | 124 | 2735 | 2750 | 960 |
| 948819 | 116000 | 116015 | TAATGGTGGGCCGGCT | 83 | 2744 | 2759 | 961 |
| 948820 | 116002 | 116017 | GATAATGGTGGGCCGG | 96 | 2746 | 2761 | 962 |
| 948821 | 116003 | 116018 | GGATAATGGTGGGCCG | 73 | 2747 | 2762 | 963 |
| 948822 | 116004 | 116019 | CGGATAATGGTGGGCC | 41 | 2748 | 2763 | 964 |
| 948823 | 116014 | 116029 | CTCGGCTGGGCGGATA | 109 | 2758 | 2773 | 965 |
| 948824 | 116023 | 116038 | CAGGGATGGCTCGGCT | 48 | 2767 | 2782 | 966 |
| 948825 | 116028 | 116043 | TCGAGCAGGGATGGCT | 84 | 2772 | 2787 | 967 |
| 948826 | 116029 | 116044 | GTCGAGCAGGGATGGC | 135 | 2773 | 2788 | 968 |
| 948827 | 116034 | 116049 | GCCTAGTCGAGCAGGG | 84 | 2778 | 2793 | 969 |
| 948828 | 116055 | 116070 | CGAGAGCACGCCCCCC | 37 | 2799 | 2814 | 970 |
| 948829 | 116058 | 116073 | CCCCGAGAGCACGCCC | 73 | 2802 | 2817 | 971 |
| 948830 | 116092 | 116107 | ACTGAAGCTCCTGCGC | 75 | 2836 | 2851 | 972 |
| 948831 | 116109 | 116124 | GCGGAGGGCCCCAGAC | 94 | 2853 | 2868 | 973 |
| 948832 | 116163 | 116178 | GTTAAGGAAGAGGCCA | 27 | 2907 | 2922 | 974 |
| 948833 | 116210 | 116225 | TGCGGTGTCCAGCCAG | 42 | 2954 | 2969 | 975 |
| 948834 | 116212 | 116227 | AGTGCGGTGTCCAGCC | 24 | 2956 | 2971 | 976 |
| 948835 | 116213 | 116228 | CAGTGCGGTGTCCAGC | 9 | 2957 | 2972 | 977 |
| 948836 | 116214 | 116229 | GCAGTGCGGTGTCCAG | 11 | 2958 | 2973 | 978 |
| 948837 | 116216 | 116231 | GCGCAGTGCGGTGTCC | 60 | 2960 | 2975 | 979 |
| 948838 | 116217 | 116232 | TGCGCAGTGCGGTGTC | 58 | 2961 | 2976 | 980 |
| 948839 | 116221 | 116236 | CCTTTGCGCAGTGCGG | 57 | 2965 | 2980 | 981 |
| 948840 | 116222 | 116237 | CCCTTTGCGCAGTGCG | 21 | 2966 | 2981 | 982 |
| 948841 | 116224 | 116239 | GCCCCTTTGCGCAGTG | 104 | 2968 | 2983 | 983 |
| 948842 | 116225 | 116240 | GGCCCCTTTGCGCAGT | 98 | 2969 | 2984 | 984 |
| 948843 | 116261 | 116276 | GTGCAACACCCCAGCG | 58 | 3005 | 3020 | 985 |
| 948844 | 116266 | 116281 | CCAAAGTGCAACACCC | 31 | 3010 | 3025 | 986 |
| 948845 | 116267 | 116282 | CCCAAAGTGCAACACC | 82 | 3011 | 3026 | 987 |
| 948846 | 116288 | 116303 | TGCCACCCTGAGACTC | 62 | 3032 | 3047 | 988 |
| 948847 | 116310 | 116325 | TCAAGGGTTCTGGTCC | 10 | 3054 | 3069 | 989 |
| 948848 | 116311 | 116326 | GTCAAGGGTTCTGGTC | 28 | 3055 | 3070 | 990 |
| 948849 | 116313 | 116328 | GTGTCAAGGGTTCTGG | 8 | 3057 | 3072 | 991 |
| 948850 | 116315 | 116330 | TGGTGTCAAGGGTTCT | 6 | 3059 | 3074 | 992 |
| 948851 | 116316 | 116331 | ATGGTGTCAAGGGTTC | 5 | 3060 | 3075 | 993 |
| 948852 | 116317 | 116332 | GATGGTGTCAAGGGTT | 6 | 3061 | 3076 | 994 |
| 948853 | 116319 | 116334 | AGGATGGTGTCAAGGG | 13 | 3063 | 3078 | 995 |
| 948854 | 116320 | 116335 | CAGGATGGTGTCAAGG | 11 | 3064 | 3079 | 996 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948855 | 116321 | 116336 | TCAGGATGGTGTCAAG | 13 | 3065 | 3080 | 997 |
| 948856 | 116323 | 116338 | ATTCAGGATGGTGTCA | 13 | 3067 | 3082 | 998 |
| 948857 | 116325 | 116340 | TCATTCAGGATGGTGT | 20 | 3069 | 3084 | 999 |
| 948858 | 116327 | 116342 | CCTCATTCAGGATGGT | 82 | 3071 | 3086 | 1000 |
| 948859 | 116351 | 116366 | GTAGAGTCCCCCCCAG | 22 | 3095 | 3110 | 1001 |
| 948860 | 116353 | 116368 | TGGTAGAGTCCCCCCC | 44 | 3097 | 3112 | 1002 |
| 948861 | 116354 | 116369 | TTGGTAGAGTCCCCCC | 19 | 3098 | 3113 | 1003 |
| 948862 | 116355 | 116370 | CTTGGTAGAGTCCCCC | 9 | 3099 | 3114 | 1004 |
| 948863 | 116357 | 116372 | ACCTTGGTAGAGTCCC | 4 | 3101 | 3116 | 1005 |
| 948864 | 116358 | 116373 | GACCTTGGTAGAGTCC | 94 | 3102 | 3117 | 1006 |
| 948865 | 116361 | 116376 | GAAGACCTTGGTAGAG | 6 | 3105 | 3120 | 1007 |
| 948866 | 116363 | 116378 | AAGAAGACCTTGGTAG | 17 | 3107 | 3122 | 1008 |
| 948867 | 116364 | 116379 | CAAGAAGACCTTGGTA | 60 | 3108 | 3123 | 1009 |
| 948868 | 116365 | 116380 | CCAAGAAGACCTTGGT | 62 | 3109 | 3124 | 1010 |
| 948869 | 116366 | 116381 | CCCAAGAAGACCTTGG | 70 | 3110 | 3125 | 1011 |
| 948870 | 116367 | 116382 | GCCCAAGAAGACCTTG | 60 | 3111 | 3126 | 1012 |
| 948871 | 116384 | 116399 | CTACATGGGCTTTCCC | 85 | 3128 | 3143 | 1013 |
| 948872 | 116386 | 116401 | CCCTACATGGGCTTTC | 98 | 3130 | 3145 | 1014 |
| 948873 | 116399 | 116414 | TATAGAAGGCCTGCCC | 100 | 3143 | 3158 | 1015 |
| 948874 | 116401 | 116416 | CTTATAGAAGGCCTGC | 20 | 3145 | 3160 | 1016 |
| 948875 | 116402 | 116417 | ACTTATAGAAGGCCTG | 25 | 3146 | 3161 | 1017 |
| 948876 | 116403 | 116418 | CACTTATAGAAGGCCT | 34 | 3147 | 3162 | 1018 |
| 948877 | 116405 | 116420 | CGCACTTATAGAAGGC | 57 | 3149 | 3164 | 1019 |
| 948878 | 116406 | 116421 | CCGCACTTATAGAAGG | 83 | 3150 | 3165 | 1020 |
| 948879 | 116450 | 116465 | CCCTGCACCCCAGCAA | 128 | 3194 | 3209 | 1021 |
| 948880 | 116454 | 116469 | ATACCCCTGCACCCCA | 18 | 3198 | 3213 | 1022 |
| 948881 | 116456 | 116471 | ATATACCCCTGCACCC | 45 | 3200 | 3215 | 1023 |
| 948882 | 116457 | 116472 | GATATACCCCTGCACC | 11 | 3201 | 3216 | 1024 |
| 948883 | 116458 | 116473 | TGATATACCCCTGCAC | 13 | 3202 | 3217 | 1025 |
| 948884 | 116459 | 116474 | TTGATATACCCCTGCA | 9 | 3203 | 3218 | 1026 |
| 948885 | 116460 | 116475 | GTTGATATACCCCTGC | 4 | 3204 | 3219 | 1027 |
| 948886 | 116465 | 116480 | GGGAAGTTGATATACC | 14 | 3209 | 3224 | 1028 |
| 948887 | 116466 | 116481 | TGGGAAGTTGATATAC | 20 | 3210 | 3225 | 1029 |
| 948888 | 116468 | 116483 | AATGGGAAGTTGATAT | 59 | 3212 | 3227 | 1030 |
| 948889 | 116469 | 116484 | TAATGGGAAGTTGATA | 49 | 3213 | 3228 | 1031 |
| 948890 | 116470 | 116485 | CTAATGGGAAGTTGAT | 15 | 3214 | 3229 | 1032 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948891 | 116472 | 116487 | TGCTAATGGGAAGTTG | 12 | 3216 | 3231 | 1033 |
| 948892 | 116473 | 116488 | CTGCTAATGGGAAGTT | 4 | 3217 | 3232 | 1034 |
| 948893 | 116475 | 116490 | TCCTGCTAATGGGAAG | 2 | 3219 | 3234 | 1035 |
| 948894 | 116476 | 116491 | CTCCTGCTAATGGGAA | 86 | 3220 | 3235 | 1036 |
| 948895 | 116479 | 116494 | GAGCTCCTGCTAATGG | 94 | 3223 | 3238 | 1037 |
| 948896 | 116498 | 116513 | GGCCAGGCTTGCCGCT | 99 | 3242 | 3257 | 1038 |
| 948897 | 116512 | 116527 | TACCGAGCCCACTGGG | 103 | 3256 | 3271 | 1039 |
| 948898 | 116515 | 116530 | CACTACCGAGCCCACT | 82 | 3259 | 3274 | 1040 |
| 948899 | 116517 | 116532 | GGCACTACCGAGCCCA | 64 | 3261 | 3276 | 1041 |
| 948900 | 116520 | 116535 | CTGGGCACTACCGAGC | 92 | 3264 | 3279 | 1042 |
| 948901 | 116525 | 116540 | GCCAGCTGGGCACTAC | 149 | 3269 | 3284 | 1043 |
| 948902 | 116526 | 116541 | TGCCAGCTGGGCACTA | 130 | 3270 | 3285 | 1044 |
| 948903 | 116539 | 116554 | TACACCTCAGGCCTGC | 28 | 3283 | 3298 | 1045 |
| 948904 | 116540 | 116555 | GTACACCTCAGGCCTG | 98 | 3284 | 3299 | 1046 |
| 948905 | 116542 | 116557 | ATGTACACCTCAGGCC | 77 | 3286 | 3301 | 1047 |
| 948906 | 116543 | 116558 | TATGTACACCTCAGGC | 9 | 3287 | 3302 | 1048 |
| 948907 | 116545 | 116560 | ACTATGTACACCTCAG | 5 | 3289 | 3304 | 1049 |
| 948908 | 116546 | 116561 | GACTATGTACACCTCA | 16 | 3290 | 3305 | 1050 |
| 948909 | 116548 | 116563 | AGGACTATGTACACCT | 125 | 3292 | 3307 | 1051 |
| 948910 | 116549 | 116564 | AAGGACTATGTACACC | 5 | 3293 | 3308 | 1052 |
| 948911 | 116551 | 116566 | GGAAGGACTATGTACA | 11 | 3295 | 3310 | 1053 |
| 948912 | 116552 | 116567 | GGGAAGGACTATGTAC | 28 | 3296 | 3311 | 1054 |
| 948913 | 116553 | 116568 | CGGGAAGGACTATGTA | 16 | 3297 | 3312 | 1055 |
| 948914 | 116554 | 116569 | CCGGGAAGGACTATGT | 60 | 3298 | 3313 | 1056 |
| 948915 | 116555 | 116570 | GCCGGGAAGGACTATG | 40 | 3299 | 3314 | 1057 |
| 948916 | 116560 | 116575 | ATATGGCCGGGAAGGA | 21 | 3304 | 3319 | 1058 |
| 948917 | 116562 | 116577 | TAATATGGCCGGGAAG | 2 | 3306 | 3321 | 1059 |
| 948918 | 116563 | 116578 | TTAATATGGCCGGGAA | 9 | 3307 | 3322 | 1060 |
| 948919 | 116564 | 116579 | GTTAATATGGCCGGGA | 16 | 3308 | 3323 | 1061 |
| 948920 | 116566 | 116581 | TGGTTAATATGGCCGG | 37 | 3310 | 3325 | 1062 |
| 948921 | 116567 | 116582 | GTGGTTAATATGGCCG | 45 | 3311 | 3326 | 1063 |
| 948922 | 116568 | 116583 | TGTGGTTAATATGGCC | 10 | 3312 | 3327 | 1064 |
| 948923 | 116570 | 116585 | TGTGTGGTTAATATGG | 3 | 3314 | 3329 | 1065 |
| 948924 | 116571 | 116586 | CTGTGTGGTTAATATG | 4 | 3315 | 3330 | 1066 |
| 948925 | 116572 | 116587 | GCTGTGTGGTTAATAT | 7 | 3316 | 3331 | 1067 |
| 948926 | 116574 | 116589 | AGGCTGTGTGGTTAAT | 3 | 3318 | 3333 | 1068 |
| 948927 | 116618 | 116633 | GGCCTAGCAAAGGCAC | 118 | 3362 | 3377 | 1069 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948928 | 116631 | 116646 | GCCAACGGCTCCGGGC | 119 | 3375 | 3390 | 1070 |
| 948929 | 116637 | 116652 | GCCCGGGCCAACGGCT | 96 | 3381 | 3396 | 1071 |
| 948930 | 116645 | 116660 | CAAGGCCGGCCCGGGC | 131 | 3389 | 3404 | 1072 |
| 948931 | 116647 | 116662 | GGCAAGGCCGGCCCGG | 104 | 3391 | 3406 | 1073 |
| 948932 | 116652 | 116667 | AATAGGGCAAGGCCGG | 65 | 3396 | 3411 | 1074 |
| 948933 | 116653 | 116668 | GAATAGGGCAAGGCCG | 126 | 3397 | 3412 | 1075 |
| 948934 | 116654 | 116669 | GGAATAGGGCAAGGCC | 22 | 3398 | 3413 | 1076 |
| 948935 | 116656 | 116671 | GAGGAATAGGGCAAGG | 7 | 3400 | 3415 | 1077 |
| 948936 | 116657 | 116672 | AGAGGAATAGGGCAAG | 4 | 3401 | 3416 | 1078 |
| 948937 | 116658 | 116673 | GAGAGGAATAGGGCAA | 6 | 3402 | 3417 | 1079 |
| 948938 | 116660 | 116675 | AGGAGAGGAATAGGGC | 8 | 3404 | 3419 | 1080 |
| 948939 | 116705 | 116720 | ACATAGCCCAAGCCCA | 54 | 3449 | 3464 | 1081 |
| 948940 | 116706 | 116721 | CACATAGCCCAAGCCC | 72 | 3450 | 3465 | 1082 |
| 948941 | 116707 | 116722 | CCACATAGCCCAAGCC | 90 | 3451 | 3466 | 1083 |
| 948942 | 116709 | 116724 | ACCCACATAGCCCAAG | 71 | 3453 | 3468 | 1084 |
| 948943 | 116767 | 116782 | ACCCATCAGGGAGGCA | 93 | 3511 | 3526 | 1085 |
| 948944 | 116790 | 116805 | CAGAGAGAGGCCGCCC | 43 | 3534 | 3549 | 1086 |
| 948945 | 116793 | 116808 | CCTCAGAGAGAGGCCG | 134 | 3537 | 3552 | 1087 |
| 948946 | 116814 | 116829 | AGCGAGGAGTGGGTGA | 43 | 3558 | 3573 | 1088 |
| 948947 | 116817 | 116832 | CTGAGCGAGGAGTGGG | 57 | 3561 | 3576 | 1089 |
| 948948 | 116818 | 116833 | ACTGAGCGAGGAGTGG | 34 | 3562 | 3577 | 1090 |
| 948949 | 116820 | 116835 | AAACTGAGCGAGGAGT | 64 | 3564 | 3579 | 1091 |
| 948950 | 116821 | 116836 | CAAACTGAGCGAGGAG | 7 | 3565 | 3580 | 1092 |
| 948951 | 116823 | 116838 | GTCAAACTGAGCGAGG | 5 | 3567 | 3582 | 1093 |
| 948952 | 116824 | 116839 | GGTCAAACTGAGCGAG | 5 | 3568 | 3583 | 1094 |
| 948953 | 116825 | 116840 | TGGTCAAACTGAGCGA | 9 | 3569 | 3584 | 1095 |
| 948954 | 116827 | 116842 | AGTGGTCAAACTGAGC | 5 | 3571 | 3586 | 1096 |
| 948955 | 116828 | 116843 | CAGTGGTCAAACTGAG | 64 | 3572 | 3587 | 1097 |
| 948956 | 116829 | 116844 | ACAGTGGTCAAACTGA | 73 | 3573 | 3588 | 1098 |
| 948957 | 116830 | 116845 | TACAGTGGTCAAACTG | 69 | 3574 | 3589 | 1099 |
| 948958 | 116831 | 116846 | TTACAGTGGTCAAACT | 34 | 3575 | 3590 | 1100 |
| 948959 | 116833 | 116848 | ACTTACAGTGGTCAAA | 17 | 3577 | 3592 | 1101 |
| 948960 | 116834 | 116849 | CACTTACAGTGGTCAA | 11 | 3578 | 3593 | 1102 |
| 948961 | 116835 | 116850 | GCACTTACAGTGGTCA | 4 | 3579 | 3594 | 1103 |
| 948962 | 116836 | 116851 | GGCACTTACAGTGGTC | 45 | 3580 | 3595 | 1104 |
| 948963 | 116837 | 116852 | AGGCACTTACAGTGGT | 5 | 3581 | 3596 | 1105 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 948964 | 116841 | 116856 | GTGCAGGCACTTACAG | 43 | 3585 | 3600 | 1106 |
| 948965 | 116844 | 116859 | AGAGTGCAGGCACTTA | 7 | 3588 | 3603 | 1107 |
| 948966 | 116846 | 116861 | ACAGAGTGCAGGCACT | 8 | 3590 | 3605 | 1108 |
| 948967 | 116847 | 116862 | TACAGAGTGCAGGCAC | 12 | 3591 | 3606 | 1109 |
| 948968 | 116848 | 116863 | ATACAGAGTGCAGGCA | 6 | 3592 | 3607 | 1110 |
| 948969 | 116850 | 116865 | GAATACAGAGTGCAGG | 6 | 3594 | 3609 | 1111 |
| 948970 | 116851 | 116866 | AGAATACAGAGTGCAG | 2 | 3595 | 3610 | 1112 |
| 948971 | 116852 | 116867 | TAGAATACAGAGTGCA | 1 | 3596 | 3611 | 1113 |
| 948972 | 116854 | 116869 | AATAGAATACAGAGTG | 6 | 3598 | 3613 | 1114 |
| 948973 | 3394 | 3409 | GCTCACCGGCCCACGA | 72 | N/A | N/A | 1115 |
| 948974 | 3500 | 3515 | CGCGGGCACGCAAGCG | 144 | N/A | N/A | 1116 |
| 948975 | 3607 | 3622 | CGTGACACCGCCCCTG | 71 | N/A | N/A | 1117 |
| 948976 | 3715 | 3730 | ATCTACCCCAGACCCA | 63 | N/A | N/A | 1118 |
| 948977 | 3725 | 3740 | CAGAAGAGGGATCTAC | 99 | N/A | N/A | 1119 |
| 948978 | 3776 | 3791 | CAATAGATATCTAGAT | 144 | N/A | N/A | 1120 |
| 948979 | 3778 | 3793 | CCCAATAGATATCTAG | 59 | N/A | N/A | 1121 |
| 948980 | 3815 | 3830 | AGATACAAGAACAAGC | 67 | N/A | N/A | 1122 |
| 948981 | 3934 | 3949 | AGCTAGCCAGACAGCA | 146 | N/A | N/A | 1123 |
| 948982 | 4010 | 4025 | CAACAGAGGGACTGCT | 85 | N/A | N/A | 1124 |
| 948983 | 4035 | 4050 | ACAGTAGAGGCCAGCT | 96 | N/A | N/A | 1125 |
| 948984 | 4130 | 4145 | CGGAAGAGAGGAGCCA | 84 | N/A | N/A | 1126 |
| 948985 | 4135 | 4150 | TCACACGGAAGAGAGG | 63 | N/A | N/A | 1127 |
| 948986 | 4142 | 4157 | GAAGAATTCACACGGA | 50 | N/A | N/A | 1128 |
| 948987 | 4262 | 4277 | GTCCAAACCTCCTCCT | 63 | N/A | N/A | 1129 |
| 948988 | 4315 | 4330 | TCCTGAAGTAAGGTAC | 96 | N/A | N/A | 1130 |
| 948989 | 4326 | 4341 | TCGGAAAGGAATCCTG | 40 | N/A | N/A | 1131 |
| 948990 | 4371 | 4386 | AATTTGTAGGCTGTAG | 21 | N/A | N/A | 1132 |
| 948991 | 4388 | 4403 | TCCAAAGGAGGGCCCC | 140 | N/A | N/A | 1133 |
| 948992 | 4476 | 4491 | CACCGCGGCTTCTCAA | 38 | N/A | N/A | 1134 |
| 948993 | 4624 | 4639 | GAGAAGTGGCCGCCCA | 75 | N/A | N/A | 1135 |
| 948994 | 4649 | 4664 | CCACAAATGAGTAGTT | 49 | N/A | N/A | 1136 |
| 948995 | 4730 | 4745 | CATTATCCCTTGACAA | 115 | N/A | N/A | 1137 |
| 948996 | 4742 | 4757 | ATCAAGAAGGGACATT | 85 | N/A | N/A | 1138 |
| 948997 | 4838 | 4853 | GGTGATCACAGTCCCT | 72 | N/A | N/A | 1139 |
| 948998 | 4938 | 4953 | AGAGACAAGGTAGCAA | 45 | N/A | N/A | 1140 |
| 948999 | 4950 | 4965 | AGGCAATGAGCTAGAG | 39 | N/A | N/A | 1141 |
| 949000 | 5049 | 5064 | GAAGATGGTCACTCAA | 47 | N/A | N/A | 1142 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949001 | 5051 | 5066 | AGGAAGATGGTCACTC | 32 | N/A | N/A | 1143 |
| 949002 | 5162 | 5177 | GTCAACCAAGACTTAG | 48 | N/A | N/A | 1144 |
| 949003 | 5545 | 5560 | TAGAATGGCATCTTGT | 28 | N/A | N/A | 1145 |
| 949004 | 5710 | 5725 | CCGGATCTGGTTCTGT | 88 | N/A | N/A | 1146 |
| 949005 | 5810 | 5825 | AACCAGCCAGATAAAC | 94 | N/A | N/A | 1147 |
| 949006 | 5872 | 5887 | GCTTAAGTGTGTAACG | 8 | N/A | N/A | 1148 |
| 949007 | 5873 | 5888 | GGCTTAAGTGTGTAAC | 10 | N/A | N/A | 1149 |
| 949008 | 5898 | 5913 | GATTATAGCAATGCCT | 22 | N/A | N/A | 1150 |
| 949009 | 5940 | 5955 | GCTCAGCTATCTGAGC | 107 | N/A | N/A | 1151 |
| 949010 | 6074 | 6089 | CCAGACACCATGGTAG | 33 | N/A | N/A | 1152 |
| 949011 | 6150 | 6165 | ATATAATGAGCAACTC | 47 | N/A | N/A | 1153 |
| 949012 | 6174 | 6189 | GTGAGACTCGGTGTAA | 10 | N/A | N/A | 1154 |
| 949013 | 6298 | 6313 | GTGGTAACGCGCGCCT | 41 | N/A | N/A | 1155 |
| 949014 | 6455 | 6470 | AATACTCTTAACGAGG | 95 | N/A | N/A | 1156 |
| 949015 | 6556 | 6571 | ACCTTATCTCTTACAC | 63 | N/A | N/A | 1157 |
| 949016 | 6697 | 6712 | TCCAGGCTCGGCGCAA | 83 | N/A | N/A | 1158 |
| 949017 | 6752 | 6767 | AGCTATAGGGCTGAAC | 129 | N/A | N/A | 1159 |
| 949018 | 6816 | 6831 | CGCAGGTAAAACAAAA | 38 | N/A | N/A | 1160 |
| 949019 | 6817 | 6832 | ACGCAGGTAAAACAAA | 56 | N/A | N/A | 1161 |
| 949020 | 6821 | 6836 | AGCTACGCAGGTAAAA | 66 | N/A | N/A | 1162 |
| 949021 | 6824 | 6839 | AAAAGCTACGCAGGTA | 27 | N/A | N/A | 1163 |
| 949022 | 6870 | 6885 | CCGGATATTGACTGGA | 46 | N/A | N/A | 1164 |
| 949023 | 6891 | 6906 | TGTCTTAGAGCCACAA | 131 | N/A | N/A | 1165 |
| 949024 | 6906 | 6921 | CTCTATAGATCTGAGT | 123 | N/A | N/A | 1166 |
| 949025 | 6918 | 6933 | GACAACTCAGAACTCT | 93 | N/A | N/A | 1167 |
| 949026 | 7031 | 7046 | TACCACCCTCAGCTTA | 69 | N/A | N/A | 1168 |
| 949027 | 7131 | 7146 | CGCCAGGTGAAACTGA | 86 | N/A | N/A | 1169 |
| 949028 | 7155 | 7170 | CCACAAGGGACAAAGG | 89 | N/A | N/A | 1170 |
| 949029 | 7170 | 7185 | TCGAAGCCATTACTGC | 89 | N/A | N/A | 1171 |
| 949030 | 7248 | 7263 | TGCTAGGGAGTAGTGG | 47 | N/A | N/A | 1172 |
| 949031 | 7273 | 7288 | GCAAAATGATCTAGGC | 26 | N/A | N/A | 1173 |
| 949032 | 7328 | 7343 | CCGCAGACAAGCCAGG | 99 | N/A | N/A | 1174 |
| 949033 | 7351 | 7366 | CCAAAGTTCTATCTGC | 15 | N/A | N/A | 1175 |
| 949034 | 7395 | 7410 | TGACAAGGGTCAAGAG | 91 | N/A | N/A | 1176 |
| 949035 | 7400 | 7415 | CTAAATGACAAGGGTC | 22 | N/A | N/A | 1177 |
| 949036 | 7402 | 7417 | GGCTAAATGACAAGGG | 47 | N/A | N/A | 1178 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949037 | 7645 | 7660 | GTATAAGACCCTATCT | 83 | N/A | N/A | 1179 |
| 949038 | 7849 | 7864 | ATTTGAGGCGAGGAGG | 58 | N/A | N/A | 1180 |
| 949050 | 8567 | 8582 | TTTTAAAGAAGACGGG | 51 | N/A | N/A | 1181 |
| 949051 | 8584 | 8599 | TGCTATTATAACTCCT | 15 | N/A | N/A | 1182 |
| 949052 | 8671 | 8686 | GAACAACACCTAATGT | 47 | N/A | N/A | 1183 |
| 949053 | 8675 | 8690 | GAACGAACAACACCTA | 8 | N/A | N/A | 1184 |
| 949054 | 8678 | 8693 | AATGAACGAACAACAC | 22 | N/A | N/A | 1185 |
| 949055 | 8705 | 8720 | AGTAAAAGTACTCAGG | 8 | N/A | N/A | 1186 |
| 949056 | 8740 | 8755 | TGGTAACTTGCTCAGG | 16 | N/A | N/A | 1187 |
| 949057 | 8773 | 8788 | GCTGAAAGGCCAGCTC | 83 | N/A | N/A | 1188 |
| 949058 | 8949 | 8964 | CTACAGGTGTCACCAT | 100 | N/A | N/A | 1189 |
| 949059 | 9093 | 9108 | ACTTATCGCCTTTTTT | 11 | N/A | N/A | 1190 |
| 949061 | 9613 | 9628 | CTCCACTGGCCTGCTA | 4 | N/A | N/A | 1191 |
| 949062 | 9724 | 9739 | AGGGACAGCAGTAGCG | 69 | N/A | N/A | 1192 |
| 949063 | 9830 | 9845 | AGAAAAATGGCACGGG | 41 | N/A | N/A | 1193 |
| 949064 | 9883 | 9898 | TAAAAACGCAGCTGGA | 79 | N/A | N/A | 1194 |
| 949065 | 9971 | 9986 | TGCACTGGTGCAGCAC | 115 | N/A | N/A | 1195 |
| 949066 | 10072 | 10087 | GGCTCTAAACTAATAA | 143 | N/A | N/A | 1196 |
| 949067 | 10260 | 10275 | TCGGGATTCACTATGT | 28 | N/A | N/A | 1197 |
| 949068 | 10379 | 10394 | CGCTTACTGCAAGTTC | 40 | N/A | N/A | 1198 |
| 949069 | 10481 | 10496 | CCTAACCGAGCCTTGC | 78 | N/A | N/A | 1199 |
| 949070 | 10675 | 10690 | ACAACAATTTGCTACG | 45 | N/A | N/A | 1200 |
| 949071 | 10677 | 10692 | TCACAACAATTTGCTA | 23 | N/A | N/A | 1201 |
| 949072 | 11266 | 11281 | TGACACCAAACTGAGC | 92 | N/A | N/A | 1202 |
| 949073 | 11356 | 11371 | AAAGAAACTAAGGCCG | 87 | N/A | N/A | 1203 |
| 949074 | 11384 | 11399 | TAATGATGAGTTCCTT | 14 | N/A | N/A | 1204 |
| 949075 | 11392 | 11407 | CAACAGAGTAATGATG | 54 | N/A | N/A | 1205 |
| 949076 | 11496 | 11511 | CGATATTTCAGGATCT | 88 | N/A | N/A | 1206 |
| 949077 | 11597 | 11612 | CTCATCACCGTACACA | 9 | N/A | N/A | 1207 |
| 949078 | 11881 | 11896 | CCCTATCATTGGTTTT | 55 | N/A | N/A | 1208 |
| 949079 | 11984 | 11999 | TAACAGGTCTTGTGCA | 55 | N/A | N/A | 1209 |
| 949080 | 12093 | 12108 | ACGATTCACATGTGGG | 11 | N/A | N/A | 1210 |
| 949081 | 12141 | 12156 | AACCTAATCCCCAAAC | 104 | N/A | N/A | 1211 |
| 949082 | 12195 | 12210 | AGCACTTGGACAGCCT | 36 | N/A | N/A | 1212 |
| 949083 | 12200 | 12215 | GAAAAAGCACTTGGAC | 31 | N/A | N/A | 1213 |
| 949084 | 12214 | 12229 | CAATAAGTAACTCTGA | 52 | N/A | N/A | 1214 |
| 949085 | 12318 | 12333 | ATCTACAACTGTCCCC | 25 | N/A | N/A | 1215 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949086 | 12555 | 12570 | AATAATGAGACCCCAC | 145 | N/A | N/A | 1216 |
| 949087 | 12667 | 12682 | TAAATCTAACCTAGGC | 126 | N/A | N/A | 1217 |
| 949088 | 12778 | 12793 | CAGAAGTTTGGCAGAT | 5 | N/A | N/A | 1218 |
| 949089 | 12788 | 12803 | TCAAATCGGGCAGAAG | 22 | N/A | N/A | 1219 |
| 949090 | 12858 | 12873 | AAATTACGGTTTACAT | 71 | N/A | N/A | 1220 |
| 949091 | 12859 | 12874 | TAAATTACGGTTTACA | 20 | N/A | N/A | 1221 |
| 949092 | 12878 | 12893 | TTGTAGTTGGCAATCC | 12 | N/A | N/A | 1222 |
| 949093 | 12892 | 12907 | GGCTTAATTACAGCTT | 86 | N/A | N/A | 1223 |
| 949094 | 12901 | 12916 | CACAATAAGGGCTTAA | 10 | N/A | N/A | 1224 |
| 949095 | 12902 | 12917 | ACACAATAAGGGCTTA | 10 | N/A | N/A | 1225 |
| 949096 | 12947 | 12962 | CCCTATAAATATCTCA | 23 | N/A | N/A | 1226 |
| 949097 | 13037 | 13052 | ACGCACCCGGAAGCAG | 71 | N/A | N/A | 1227 |
| 949098 | 13140 | 13155 | AAACAGTCATCCAGCT | 105 | N/A | N/A | 1228 |
| 949099 | 13208 | 13223 | TGGCACACGGTGATTC | 57 | N/A | N/A | 1229 |
| 949100 | 13215 | 13230 | GCACATGTGGCACACG | 27 | N/A | N/A | 1230 |
| 949101 | 13273 | 13288 | AGGGATGCTAAGAGCA | 69 | N/A | N/A | 1231 |
| 949102 | 13281 | 13296 | TATAAAGCAGGGATGC | 117 | N/A | N/A | 1232 |
| 949103 | 13391 | 13406 | CCATATGTGTGGCTCT | 21 | N/A | N/A | 1233 |
| 949104 | 13520 | 13535 | GCATATCCAAAGCCAC | 38 | N/A | N/A | 1234 |
| 949105 | 13635 | 13650 | CATTTAACTGTTCACC | 28 | N/A | N/A | 1235 |
| 949106 | 13812 | 13827 | CGACAGACAAGTACCA | 46 | N/A | N/A | 1236 |
| 949107 | 13952 | 13967 | GCATACAGCCTTTTTT | 38 | N/A | N/A | 1237 |
| 949108 | 13953 | 13968 | CGCATACAGCCTTTTT | 15 | N/A | N/A | 1238 |
| 949109 | 13955 | 13970 | ACCGCATACAGCCTTT | 9 | N/A | N/A | 1239 |
| 949110 | 13956 | 13971 | CACCGCATACAGCCTT | 46 | N/A | N/A | 1240 |
| 949111 | 13959 | 13974 | AACCACCGCATACAGC | 50 | N/A | N/A | 1241 |
| 949112 | 13961 | 13976 | TGAACCACCGCATACA | 40 | N/A | N/A | 1242 |
| 949113 | 14262 | 14277 | TGCAACCTTCAAGTAA | 94 | N/A | N/A | 1243 |
| 949114 | 14390 | 14405 | GCAAACCGCTTCTCAC | 74 | N/A | N/A | 1244 |
| 949115 | 14492 | 14507 | CCCCAAGTCCTGGCGG | 99 | N/A | N/A | 1245 |
| 949116 | 14629 | 14644 | GAAAAGTCGGCATTCC | 74 | N/A | N/A | 1246 |
| 949117 | 14757 | 14772 | TGACAGTGGTGCTCCC | 66 | N/A | N/A | 1247 |
| 949118 | 15000 | 15015 | TGGCATGTGGTTGTTG | 26 | N/A | N/A | 1248 |
| 949119 | 15165 | 15180 | AACAAATATATGCACG | 20 | N/A | N/A | 1249 |
| 949120 | 15370 | 15385 | TCGCACCTCGGGATTC | 92 | N/A | N/A | 1250 |
| 949121 | 15507 | 15522 | GTGAAATTCACTCCAT | 40 | N/A | N/A | 1251 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949122 | 15612 | 15627 | GGAAGATGTCCTTGCT | 49 | N/A | N/A | 1252 |
| 949123 | 15643 | 15658 | ATAGATGGAGCAAATC | 77 | N/A | N/A | 1253 |
| 949124 | 15647 | 15662 | TTATATAGATGGAGCA | 32 | N/A | N/A | 1254 |
| 949125 | 15708 | 15723 | ACGCAGATAGACACCC | 53 | N/A | N/A | 1255 |
| 949126 | 15712 | 15727 | GCCAACGCAGATAGAC | 93 | N/A | N/A | 1256 |
| 949127 | 15777 | 15792 | TGCCATACAGGGCCTC | 116 | N/A | N/A | 1257 |
| 949128 | 15859 | 15874 | GAAAGAGCAGTGGTGC | 73 | N/A | N/A | 1258 |
| 949129 | 15973 | 15988 | GGGCATGGAGGTGTCA | 90 | N/A | N/A | 1259 |
| 949130 | 16025 | 16040 | CGCGAAAGTGTGTCAC | 64 | N/A | N/A | 1260 |
| 949131 | 16117 | 16132 | TATCACCCAGCAGGCA | 75 | N/A | N/A | 1261 |
| 949132 | 16275 | 16290 | GGCCAGCTGGTAGGCC | 114 | N/A | N/A | 1262 |
| 949134 | 16714 | 16729 | GTCAAGCTGAGCCAGT | 52 | N/A | N/A | 1263 |
| 949135 | 16815 | 16830 | ACAGAAGCCGGGCTTC | 127 | N/A | N/A | 1264 |
| 949136 | 16926 | 16941 | ATCAATTTTCACCCAG | 19 | N/A | N/A | 1265 |
| 949137 | 16930 | 16945 | GTGCATCAATTTTCAC | 127 | N/A | N/A | 1266 |
| 949138 | 17244 | 17259 | AAAGAGTTTAAGGGCG | 57 | N/A | N/A | 1267 |
| 949139 | 17282 | 17297 | CCACAACGAGTAAACA | 15 | N/A | N/A | 1268 |
| 949140 | 17615 | 17630 | GGACAGGGTGAATTGT | 62 | N/A | N/A | 1269 |
| 949141 | 17723 | 17738 | AGTCACACCTAGAAAT | 32 | N/A | N/A | 1270 |
| 949142 | 17758 | 17773 | GACTTATAGGCTCACT | 12 | N/A | N/A | 1271 |
| 949143 | 17763 | 17778 | TACTAGACTTATAGGC | 26 | N/A | N/A | 1272 |
| 949144 | 17765 | 17780 | GTTACTAGACTTATAG | 19 | N/A | N/A | 1273 |
| 949145 | 17766 | 17781 | TGTTACTAGACTTATA | 40 | N/A | N/A | 1274 |
| 949146 | 17834 | 17849 | ATATAGCAGGGACCTG | 70 | N/A | N/A | 1275 |
| 949147 | 17838 | 17853 | CTAAATATAGCAGGGA | 36 | N/A | N/A | 1276 |
| 949148 | 17840 | 17855 | CACTAAATATAGCAGG | 24 | N/A | N/A | 1277 |
| 949149 | 18278 | 18293 | TTTGAGCCCGAGAGGG | 46 | N/A | N/A | 1278 |
| 949150 | 18486 | 18501 | TTATTTCTAGGCAGGG | 13 | N/A | N/A | 1279 |
| 949151 | 18524 | 18539 | GTAAATTTGAAGCTTA | 144 | N/A | N/A | 1280 |
| 949152 | 18583 | 18598 | AATTAGAGGACACTGG | 19 | N/A | N/A | 1281 |
| 949153 | 18665 | 18680 | GCTTTAACTCCTAGAC | 61 | N/A | N/A | 1282 |
| 949154 | 19040 | 19055 | GTATACCAAGGTTAAT | 56 | N/A | N/A | 1283 |
| 949155 | 19050 | 19065 | CTTAATAGTAGTATAC | 96 | N/A | N/A | 1284 |
| 949156 | 19458 | 19473 | CACACGAGGTCTCACT | 44 | N/A | N/A | 1285 |
| 949157 | 19461 | 19476 | CTACACACGAGGTCTC | 72 | N/A | N/A | 1286 |
| 949158 | 19663 | 19678 | TACATTCTGGCTTTGG | 12 | N/A | N/A | 1287 |
| 949159 | 19763 | 19778 | TCTCAGTATGTATACT | 12 | N/A | N/A | 1288 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949160 | 19814 | 19829 | TGTCCAGTCCTAAGAC | 101 | N/A | N/A | 1289 |
| 949161 | 19816 | 19831 | AATGTCCAGTCCTAAG | 81 | N/A | N/A | 1290 |
| 949162 | 19817 | 19832 | CAATGTCCAGTCCTAA | 19 | N/A | N/A | 1291 |
| 949163 | 19818 | 19833 | GCAATGTCCAGTCCTA | 4 | N/A | N/A | 1292 |
| 949164 | 19820 | 19835 | ATGCAATGTCCAGTCC | 13 | N/A | N/A | 1293 |
| 949165 | 19821 | 19836 | GATGCAATGTCCAGTC | 70 | N/A | N/A | 1294 |
| 949166 | 19822 | 19837 | AGATGCAATGTCCAGT | 13 | N/A | N/A | 1295 |
| 949167 | 19824 | 19839 | CTAGATGCAATGTCCA | 12 | N/A | N/A | 1296 |
| 949168 | 19843 | 19858 | GCTTAAGGAGATCCGA | 17 | N/A | N/A | 1297 |
| 949169 | 19844 | 19859 | GGCTTAAGGAGATCCG | 85 | N/A | N/A | 1298 |
| 949170 | 19872 | 19887 | GGCTGAGTTGCTTCCC | 79 | N/A | N/A | 1299 |
| 949171 | 19935 | 19950 | TTCCAGATAAGCCCTA | 32 | N/A | N/A | 1300 |
| 949172 | 19986 | 20001 | CACCAATGGCCTTCTT | 42 | N/A | N/A | 1301 |
| 949173 | 20328 | 20343 | GAAGATGGCTGGACGA | 34 | N/A | N/A | 1302 |
| 949174 | 20330 | 20345 | CAGAAGATGGCTGGAC | 34 | N/A | N/A | 1303 |
| 949175 | 20378 | 20393 | CAATAATTTATCAGTC | 68 | N/A | N/A | 1304 |
| 949176 | 20440 | 20455 | GGGAAACCTAGCAAGC | 80 | N/A | N/A | 1305 |
| 949177 | 20487 | 20502 | CCCAAAGGATAGAGTA | 23 | N/A | N/A | 1306 |
| 949178 | 20735 | 20750 | TTACATGAGTCTAGGA | 50 | N/A | N/A | 1307 |
| 949179 | 20737 | 20752 | TATTACATGAGTCTAG | 68 | N/A | N/A | 1308 |
| 949180 | 20740 | 20755 | GATTATTACATGAGTC | 49 | N/A | N/A | 1309 |
| 949181 | 20748 | 20763 | GGCAAGAGGATTATTA | 53 | N/A | N/A | 1310 |
| 949182 | 20844 | 20859 | AGCAACTTTAGGGAGA | 5 | N/A | N/A | 1311 |
| 949183 | 20899 | 20914 | GAACAGACAGTTCAGG | 76 | N/A | N/A | 1312 |
| 949184 | 20947 | 20962 | AAGATATGTGGTTTTG | 35 | N/A | N/A | 1313 |
| 949185 | 21341 | 21356 | GAGCATCACCAGCCCA | 127 | N/A | N/A | 1314 |
| 949186 | 21403 | 21418 | TAGAAATGAGTGGGCG | 116 | N/A | N/A | 1315 |
| 949187 | 21416 | 21431 | AGCTACAGCAATATAG | 43 | N/A | N/A | 1316 |
| 949188 | 21449 | 21464 | ACTCACATGGCCTGAT | 81 | N/A | N/A | 1317 |
| 949189 | 21491 | 21506 | CTAGACTAGACAAAAC | 91 | N/A | N/A | 1318 |
| 949190 | 21514 | 21529 | ATATATATGTGGAGGC | 4 | N/A | N/A | 1319 |
| 949191 | 21561 | 21576 | CTAATACACAATGATC | 34 | N/A | N/A | 1320 |
| 949192 | 21591 | 21606 | CAAAAAACTAATACCG | 105 | N/A | N/A | 1321 |
| 949193 | 21698 | 21713 | AACCAGTACCAGCTGG | 98 | N/A | N/A | 1322 |
| 949194 | 21758 | 21773 | AGAAACTGTACTGGTC | 25 | N/A | N/A | 1323 |
| 949195 | 21845 | 21860 | GGATATTCTTAACAGG | 26 | N/A | N/A | 1324 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949196 | 21854 | 21869 | AGCTAGGAAGGATATT | 83 | N/A | N/A | 1325 |
| 949197 | 22009 | 22024 | AAGTATGCGCTGCCAT | 38 | N/A | N/A | 1326 |
| 949198 | 22018 | 22033 | TGGGACTGTAAGTATG | 63 | N/A | N/A | 1327 |
| 949199 | 22133 | 22148 | GGATATAGGGTCTCCC | 138 | N/A | N/A | 1328 |
| 949200 | 22243 | 22258 | CATGAGGTAGGACAGC | 54 | N/A | N/A | 1329 |
| 949201 | 22251 | 22266 | GAAAAAGCCATGAGGT | 100 | N/A | N/A | 1330 |
| 949202 | 22301 | 22316 | CCACAGGGTTATCTGG | 119 | N/A | N/A | 1331 |
| 949203 | 22345 | 22360 | AAGGAGGCTTTTAAGC | 92 | N/A | N/A | 1332 |
| 949204 | 22446 | 22461 | AGGAATGACAAGTGGT | 17 | N/A | N/A | 1333 |
| 949205 | 22466 | 22481 | CGCATAGGTGGAACAA | 58 | N/A | N/A | 1334 |
| 949206 | 22478 | 22493 | CAAGAAACCAAACGCA | 81 | N/A | N/A | 1335 |
| 949207 | 22638 | 22653 | AATATACGGGCATGTT | 82 | N/A | N/A | 1336 |
| 949208 | 22639 | 22654 | AAATATACGGGCATGT | 110 | N/A | N/A | 1337 |
| 949209 | 22641 | 22656 | AAAAATATACGGGCAT | 104 | N/A | N/A | 1338 |
| 949210 | 22643 | 22658 | ACAAAAATATACGGGC | 67 | N/A | N/A | 1339 |
| 949211 | 22644 | 22659 | TACAAAAATATACGGG | 33 | N/A | N/A | 1340 |
| 949212 | 22780 | 22795 | TCAAACAAATAGGCCG | 86 | N/A | N/A | 1341 |
| 949213 | 22862 | 22877 | ATGCAAGGGACTGCGC | 66 | N/A | N/A | 1342 |
| 949214 | 22883 | 22898 | ACCTATCGCATGCCAG | 17 | N/A | N/A | 1343 |
| 949215 | 23000 | 23015 | GTTCAGGTCAGAGCCT | 51 | N/A | N/A | 1344 |
| 949216 | 23297 | 23312 | TCTCAATGAAAGTCTC | 10 | N/A | N/A | 1345 |
| 949217 | 23548 | 23563 | GTAACAACCGCTGGGA | 27 | N/A | N/A | 1346 |
| 949218 | 23555 | 23570 | TTAAAGAGTAACAACC | 75 | N/A | N/A | 1347 |
| 949219 | 23715 | 23730 | GCCCAGCTAACTAACT | 108 | N/A | N/A | 1348 |
| 949220 | 24040 | 24055 | GACTACAGTACAGGCG | 74 | N/A | N/A | 1349 |
| 949221 | 24201 | 24216 | AGAACAAGGGAACACG | 80 | N/A | N/A | 1350 |
| 949222 | 24210 | 24225 | CCCCATAGAAGAACAA | 138 | N/A | N/A | 1351 |
| 949223 | 24289 | 24304 | GATTAGGTATTATGGT | 12 | N/A | N/A | 1352 |
| 949224 | 24296 | 24311 | TCAAAAGGATTAGGTA | 25 | N/A | N/A | 1353 |
| 949225 | 24315 | 24330 | ATCCACTGAATAGTAT | 32 | N/A | N/A | 1354 |
| 949226 | 24364 | 24379 | CTACAAAATCAGATAG | 91 | N/A | N/A | 1355 |
| 949227 | 24438 | 24453 | GACATTAGTGGCTTCC | 35 | N/A | N/A | 1356 |
| 949228 | 24561 | 24576 | AACCAGCATGGATGAA | 87 | N/A | N/A | 1357 |
| 949229 | 24782 | 24797 | TGCAACCTTGCCCCCC | 11 | N/A | N/A | 1358 |
| 949230 | 24934 | 24949 | TAGTATTCAAAAAACG | 80 | N/A | N/A | 1359 |
| 949231 | 25044 | 25059 | CAAATTAAATACACCC | 62 | N/A | N/A | 1360 |
| 949232 | 25058 | 25073 | GAATACTATTCTAACA | 118 | N/A | N/A | 1361 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949233 | 25210 | 25225 | CACCACAATTTGCTCT | 63 | N/A | N/A | 1362 |
| 949234 | 25305 | 25320 | TCAGAAAAGGAGGGTA | 109 | N/A | N/A | 1363 |
| 949235 | 25321 | 25336 | TTCCACTTCAAGAACC | 87 | N/A | N/A | 1364 |
| 949236 | 25696 | 25711 | TGTAAGCAACTGTATT | 49 | N/A | N/A | 1365 |
| 949237 | 25788 | 25803 | TGAGAAGATATGCTGA | 26 | N/A | N/A | 1366 |
| 949238 | 25822 | 25837 | AACCTATGTATCAAAG | 87 | N/A | N/A | 1367 |
| 949239 | 25925 | 25940 | CAAAGTAGTTCCTCCA | 34 | N/A | N/A | 1368 |
| 949240 | 25927 | 25942 | TACAAAGTAGTTCCTC | 68 | N/A | N/A | 1369 |
| 949241 | 26042 | 26057 | CCCAAGAGTAAAATAC | 105 | N/A | N/A | 1370 |
| 949242 | 26084 | 26099 | ACGAAACCAATAAGAC | 104 | N/A | N/A | 1371 |
| 949243 | 26090 | 26105 | GAAAATACGAAACCAA | 99 | N/A | N/A | 1372 |
| 949244 | 26133 | 26148 | TAATAATGGATGGAAC | 84 | N/A | N/A | 1373 |
| 949245 | 26155 | 26170 | TGGTATCAGGCAAGAA | 35 | N/A | N/A | 1374 |
| 949246 | 27033 | 27048 | CATGATGCTGCAATCA | 97 | N/A | N/A | 1375 |
| 949247 | 27177 | 27192 | CACAAGCCTGCGGACC | 110 | N/A | N/A | 1376 |
| 949248 | 27191 | 27206 | GAGCATAGCAGACACA | 65 | N/A | N/A | 1377 |
| 949249 | 27254 | 27269 | GGCAACATCACTCTAA | 62 | N/A | N/A | 1378 |
| 949250 | 27289 | 27304 | CAAAGAGCCTTGGCAC | 111 | N/A | N/A | 1379 |
| 949251 | 27390 | 27405 | CAGGACTAGTTCACTA | 78 | N/A | N/A | 1380 |
| 949252 | 27473 | 27488 | ATGAAATTGGGATAAC | 60 | N/A | N/A | 1381 |
| 949253 | 27509 | 27524 | ATGAAGGCTGCCACTT | 103 | N/A | N/A | 1382 |
| 949254 | 27575 | 27590 | AGCAAGATCATTGGGT | 65 | N/A | N/A | 1383 |
| 949255 | 27634 | 27649 | GGAAACCTTGGACTCC | 91 | N/A | N/A | 1384 |
| 949256 | 27761 | 27776 | GTCTATTGGCACACAG | 38 | N/A | N/A | 1385 |
| 949257 | 27775 | 27790 | GATTAAGTCATCCGGT | 70 | N/A | N/A | 1386 |
| 949258 | 27872 | 27887 | GGGCACTGCACAAAGC | 86 | N/A | N/A | 1387 |
| 949259 | 27975 | 27990 | AGTCAGCGGAGACTGA | 98 | N/A | N/A | 1388 |
| 949260 | 28212 | 28227 | CGGCAAAAGAAGCTGG | 133 | N/A | N/A | 1389 |
| 949261 | 28320 | 28335 | AGCTAGAGCATCAGCT | 122 | N/A | N/A | 1390 |
| 949262 | 28971 | 28986 | CTGGAAACAGTCTCGC | 29 | N/A | N/A | 1391 |
| 949263 | 29116 | 29131 | AGCCGAAGTGTAGTGG | 51 | N/A | N/A | 1392 |
| 949264 | 29258 | 29273 | GGCCAAGTCTCCCATC | 117 | N/A | N/A | 1393 |
| 949265 | 29370 | 29385 | CCGGACCCGTTCTTGA | 85 | N/A | N/A | 1394 |
| 949266 | 29501 | 29516 | AGGTAGTGACCTCCAG | 114 | N/A | N/A | 1395 |
| 949267 | 29557 | 29572 | ACCCACAGTCTGCATT | 97 | N/A | N/A | 1396 |
| 949268 | 29591 | 29606 | GCCCAAGTGAACTAGA | 94 | N/A | N/A | 1397 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949269 | 29625 | 29640 | ATGTATGGATTTCCAG | 62 | N/A | N/A | 1398 |
| 949270 | 29642 | 29657 | TTACAGGGTGGTCAGC | 82 | N/A | N/A | 1399 |
| 949271 | 29721 | 29736 | GTAAAACGGTTGTGGT | 30 | N/A | N/A | 1400 |
| 949272 | 29739 | 29754 | CAACAGGTGTCCTGCT | 64 | N/A | N/A | 1401 |
| 949273 | 29842 | 29857 | TGTCATCCTAACTGCT | 57 | N/A | N/A | 1402 |
| 949274 | 29943 | 29958 | AGAAACTGGCCGGCCC | 132 | N/A | N/A | 1403 |
| 949275 | 30052 | 30067 | TTTATAGTCTCCAACG | 34 | N/A | N/A | 1404 |
| 949276 | 30178 | 30193 | ACGGACTGGATTATGC | 27 | N/A | N/A | 1405 |
| 949277 | 30248 | 30263 | GGCTAAATCAATCTTG | 60 | N/A | N/A | 1406 |
| 949278 | 30282 | 30297 | CGATAATGACCTAAAT | 84 | N/A | N/A | 1407 |
| 949279 | 30283 | 30298 | CCGATAATGACCTAAA | 8 | N/A | N/A | 1408 |
| 949280 | 30406 | 30421 | GAATATCAACACCTTG | 35 | N/A | N/A | 1409 |
| 949281 | 30508 | 30523 | AGTGATATGCTGCCTA | 39 | N/A | N/A | 1410 |
| 949282 | 30705 | 30720 | GGTTTATTTGCACCTC | 39 | N/A | N/A | 1411 |
| 949283 | 30830 | 30845 | TACCAGGGACTCAACT | 111 | N/A | N/A | 1412 |
| 949284 | 30933 | 30948 | GGCCAGACATTGCTGT | 142 | N/A | N/A | 1413 |
| 949285 | 31273 | 31288 | CACATTGGTGGTCAAG | 98 | N/A | N/A | 1414 |
| 949286 | 31373 | 31388 | CTCATAACATTTGACG | 45 | N/A | N/A | 1415 |
| 949287 | 31708 | 31723 | AAAAAAGCCGGCACGG | 120 | N/A | N/A | 1416 |
| 949288 | 32027 | 32042 | AAAATTGGTTGAGTGC | 40 | N/A | N/A | 1417 |
| 949289 | 32161 | 32176 | GTAAAACTCAGGCTGA | 81 | N/A | N/A | 1418 |
| 949290 | 32192 | 32207 | CAAAAGAGAACATTCG | 64 | N/A | N/A | 1419 |
| 949291 | 32264 | 32279 | TGTTATGTGGGAATGA | 35 | N/A | N/A | 1420 |
| 949292 | 32420 | 32435 | AGGGACACAACAGGCT | 85 | N/A | N/A | 1421 |
| 949293 | 32560 | 32575 | CACAATCCACTCCTGG | 100 | N/A | N/A | 1422 |
| 949294 | 32561 | 32576 | CCACAATCCACTCCTG | 83 | N/A | N/A | 1423 |
| 949295 | 32615 | 32630 | TTGCAGAACAATGGGC | 105 | N/A | N/A | 1424 |
| 949296 | 32697 | 32712 | GCGCAGGGTCCCGTAT | 95 | N/A | N/A | 1425 |
| 949297 | 32719 | 32734 | TATTAGAGTGGCAGCC | 86 | N/A | N/A | 1426 |
| 949298 | 32799 | 32814 | TGCCACTCACAACTGG | 104 | N/A | N/A | 1427 |
| 949299 | 32852 | 32867 | CGCCATAGGAAGCTGC | 111 | N/A | N/A | 1428 |
| 949300 | 32895 | 32910 | GAGCAGGCGGGCAGCT | 82 | N/A | N/A | 1429 |
| 949301 | 32899 | 32914 | AACAGAGCAGGCGGGC | 92 | N/A | N/A | 1430 |
| 949302 | 32900 | 32915 | TAACAGAGCAGGCGGG | 103 | N/A | N/A | 1431 |
| 949303 | 32903 | 32918 | CATTAACAGAGCAGGC | 119 | N/A | N/A | 1432 |
| 949304 | 32904 | 32919 | GCATTAACAGAGCAGG | 46 | N/A | N/A | 1433 |
| 949305 | 33006 | 33021 | AGCCACATATGCCTCC | 91 | N/A | N/A | 1434 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949306 | 33148 | 33163 | TGTTATGGGCCCTCCT | 82 | N/A | N/A | 1435 |
| 949307 | 33277 | 33292 | TCCAAGGCTGTCAGCG | 106 | N/A | N/A | 1436 |
| 949308 | 33391 | 33406 | CACGAGGCTGCAGACC | 40 | N/A | N/A | 1437 |
| 949309 | 33454 | 33469 | CCGCAGGTAGGTGCCA | 56 | N/A | N/A | 1438 |
| 949310 | 33488 | 33503 | GCCCAAGCCTTACAGT | 117 | N/A | N/A | 1439 |
| 949311 | 33512 | 33527 | AGCCATTGGTCACCCA | 43 | N/A | N/A | 1440 |
| 949312 | 33618 | 33633 | CCGCACCCACCTCAGG | 132 | N/A | N/A | 1441 |
| 949313 | 33644 | 33659 | CACCAATGAGGCAGAC | 69 | N/A | N/A | 1442 |
| 949314 | 33725 | 33740 | GTGGACTGAGGTTCAG | 101 | N/A | N/A | 1443 |
| 949315 | 33826 | 33841 | CTCTAACCCCATCTCG | 81 | N/A | N/A | 1444 |
| 949316 | 33927 | 33942 | TCGGCAGGAGCCCACA | 108 | N/A | N/A | 1445 |
| 949317 | 34028 | 34043 | CCATATGCTCAGCACA | 30 | N/A | N/A | 1446 |
| 949318 | 34029 | 34044 | ACCATATGCTCAGCAC | 45 | N/A | N/A | 1447 |
| 949319 | 34159 | 34174 | GATAAGCCCACAGAGG | 107 | N/A | N/A | 1448 |
| 949320 | 34164 | 34179 | CAACAGATAAGCCCAC | 83 | N/A | N/A | 1449 |
| 949321 | 34281 | 34296 | ACAGACCACAAGGCTC | 65 | N/A | N/A | 1450 |
| 949322 | 34283 | 34298 | GAACAGACCACAAGGC | 82 | N/A | N/A | 1451 |
| 949323 | 34407 | 34422 | CAGGAAGGCGGTAGGG | 92 | N/A | N/A | 1452 |
| 949324 | 34539 | 34554 | TGGGAGGACACTTCCA | 121 | N/A | N/A | 1453 |
| 949325 | 34546 | 34561 | CATGAAATGGGAGGAC | 9 | N/A | N/A | 1454 |
| 949326 | 34561 | 34576 | ACTGACTTGGCCATCC | 68 | N/A | N/A | 1455 |
| 949327 | 34654 | 34669 | CCAGACTGTGGAGCCA | 35 | N/A | N/A | 1456 |
| 949328 | 34763 | 34778 | GCCAAGACTTCTGCAC | 129 | N/A | N/A | 1457 |
| 949329 | 34873 | 34888 | GCCTACCTGGCCATGG | 119 | N/A | N/A | 1458 |
| 949330 | 34995 | 35010 | GCTGACCGGGTTCCCC | 148 | N/A | N/A | 1459 |
| 949331 | 35150 | 35165 | TCCTATCCATGGGCCC | 93 | N/A | N/A | 1460 |
| 949332 | 35178 | 35193 | TACTATTGCATCATTT | 33 | N/A | N/A | 1461 |
| 949333 | 35385 | 35400 | CCCTAGTGAACTTCCC | 38 | N/A | N/A | 1462 |
| 949334 | 35541 | 35556 | GCAAACCTCAGTCTCG | 39 | N/A | N/A | 1463 |
| 949335 | 35921 | 35936 | GCACAATTAAGTAGTT | 36 | N/A | N/A | 1464 |
| 949336 | 35950 | 35965 | GCATAGAGTAGGGCTG | 55 | N/A | N/A | 1465 |
| 949337 | 35955 | 35970 | CCAAAGCATAGAGTAG | 57 | N/A | N/A | 1466 |
| 949338 | 35956 | 35971 | CCCAAAGCATAGAGTA | 62 | N/A | N/A | 1467 |
| 949339 | 36021 | 36036 | CCCATCTGAGCTGTGT | 79 | N/A | N/A | 1468 |
| 949340 | 36170 | 36185 | TCGAATGACATTTCCT | 65 | N/A | N/A | 1469 |
| 949341 | 36211 | 36226 | AGTAAGACAGGGTAAC | 136 | N/A | N/A | 1470 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949342 | 36311 | 36326 | GTGCACCCAGGCTGCC | 105 | N/A | N/A | 1471 |
| 949343 | 36420 | 36435 | TTCCAGCCTCCGTCAT | 90 | N/A | N/A | 1472 |
| 949344 | 36531 | 36546 | CCTAAGGGTTTTCTGG | 109 | N/A | N/A | 1473 |
| 949345 | 36532 | 36547 | CCCTAAGGGTTTTCTG | 144 | N/A | N/A | 1474 |
| 949346 | 36570 | 36585 | CCAGAAGTCTCCTAGG | 108 | N/A | N/A | 1475 |
| 949347 | 36647 | 36662 | CTAAAAGTTCCCAGAC | 86 | N/A | N/A | 1476 |
| 949348 | 36757 | 36772 | GGAGACGCAGCTCTCA | 103 | N/A | N/A | 1477 |
| 949349 | 36892 | 36907 | GGACAAGCACCCCTCT | 26 | N/A | N/A | 1478 |
| 949350 | 36996 | 37011 | CCCGACCCCGGCCAAT | 96 | N/A | N/A | 1479 |
| 949351 | 37100 | 37115 | GTTCACTACAGACATC | 71 | N/A | N/A | 1480 |
| 949352 | 37105 | 37120 | TTCTAGTTCACTACAG | 92 | N/A | N/A | 1481 |
| 949353 | 37243 | 37258 | CATAGTACCCCACACA | 56 | N/A | N/A | 1482 |
| 949354 | 37300 | 37315 | TTGTAGTGTGGAATAT | 40 | N/A | N/A | 1483 |
| 949355 | 37364 | 37379 | CGCCCAAGAGAACACA | 104 | N/A | N/A | 1484 |
| 949356 | 37481 | 37496 | CTCCACTTTGTGTCTG | 58 | N/A | N/A | 1485 |
| 949357 | 37583 | 37598 | GCCTTCTGAGCAAACA | 90 | N/A | N/A | 1486 |
| 949358 | 37726 | 37741 | AAAATGGGTCTGCTGG | 18 | N/A | N/A | 1487 |
| 949359 | 37730 | 37745 | CATTAAAATGGGTCTG | 56 | N/A | N/A | 1488 |
| 949360 | 37843 | 37858 | ACCTTAAGTTTCTTGT | 70 | N/A | N/A | 1489 |
| 949361 | 37896 | 37911 | TGCAATGGAGTCCAAA | 65 | N/A | N/A | 1490 |
| 949362 | 37970 | 37985 | CCTTAAGTTTTTTGGT | 132 | N/A | N/A | 1491 |
| 949363 | 38144 | 38159 | TCATGATTATTAACCT | 29 | N/A | N/A | 1492 |
| 949364 | 38160 | 38175 | AGGCATTGAGAACTTT | 77 | N/A | N/A | 1493 |
| 949365 | 38190 | 38205 | AGCTATTCAACACTGA | 65 | N/A | N/A | 1494 |
| 949366 | 38206 | 38221 | CATTAGAGTAGCTAAT | 141 | N/A | N/A | 1495 |
| 949367 | 38246 | 38261 | TTGAATTCCGCATCAT | 86 | N/A | N/A | 1496 |
| 949368 | 38313 | 38328 | AACAAAACAGGACCCG | 108 | N/A | N/A | 1497 |
| 949369 | 38353 | 38368 | GAAGAAAGTCTGTACT | 86 | N/A | N/A | 1498 |
| 949370 | 38488 | 38503 | TTGTAGTGATCAGTTT | 54 | N/A | N/A | 1499 |
| 949371 | 38588 | 38603 | ATCCATGCTGCTATGC | 63 | N/A | N/A | 1500 |
| 949372 | 38688 | 38703 | TTGCACAACAAAGAGC | 90 | N/A | N/A | 1501 |
| 949373 | 38948 | 38963 | GATATATTGCTGGGCA | 72 | N/A | N/A | 1502 |
| 949374 | 38949 | 38964 | AGATATATTGCTGGGC | 44 | N/A | N/A | 1503 |
| 949375 | 39017 | 39032 | ACCTAAGGAAGCTGAC | 72 | N/A | N/A | 1504 |
| 949376 | 39062 | 39077 | TTAAAGCCCAGCAACA | 93 | N/A | N/A | 1505 |
| 949377 | 39088 | 39103 | ACGAAAAATTCAGATC | 104 | N/A | N/A | 1506 |
| 949378 | 39089 | 39104 | GACGAAAAATTCAGAT | 83 | N/A | N/A | 1507 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949379 | 39124 | 39139 | ACAGAATTGTTACAAC | 104 | N/A | N/A | 1508 |
| 949380 | 39156 | 39171 | GTACAGGGTGGACATT | 90 | N/A | N/A | 1509 |
| 949381 | 39162 | 39177 | ACAAAAGTACAGGGTG | 66 | N/A | N/A | 1510 |
| 949382 | 39163 | 39178 | TACAAAAGTACAGGGT | 86 | N/A | N/A | 1511 |
| 949383 | 39164 | 39179 | ATACAAAAGTACAGGG | 54 | N/A | N/A | 1512 |
| 949384 | 39195 | 39210 | AGTCAAGGAGAACATG | 63 | N/A | N/A | 1513 |
| 949385 | 39529 | 39544 | TTGTAGTGGGTCACGC | 53 | N/A | N/A | 1514 |
| 949386 | 39644 | 39659 | CATGATTGCGCCGTTG | 17 | N/A | N/A | 1515 |
| 949387 | 39745 | 39760 | GTAATTCACTGCGGAT | 32 | N/A | N/A | 1516 |
| 949388 | 39877 | 39892 | AAACTTGCAGCAGTGG | 67 | N/A | N/A | 1517 |
| 949389 | 39981 | 39996 | AAATGGACTAGAAGGG | 59 | N/A | N/A | 1518 |
| 949390 | 40014 | 40029 | AGATAGAAATCAGGGC | 47 | N/A | N/A | 1519 |
| 949391 | 40058 | 40073 | TCACAGGGTGGACTTG | 53 | N/A | N/A | 1520 |
| 949392 | 40089 | 40104 | GTAGACACATGTCCTT | 49 | N/A | N/A | 1521 |
| 949393 | 40195 | 40210 | GACTACAGTCTGTTCG | 96 | N/A | N/A | 1522 |
| 949394 | 40295 | 40310 | AACACAGGAGCAGCAT | 87 | N/A | N/A | 1523 |
| 949395 | 40306 | 40321 | AACGATAAAACAACAC | 70 | N/A | N/A | 1524 |
| 949396 | 40409 | 40424 | ACTGAATCACCAGCAG | 99 | N/A | N/A | 1525 |
| 949397 | 40837 | 40852 | GCCTTTACTTAAGATA | 3 | N/A | N/A | 1526 |
| 949398 | 40961 | 40976 | ACGCAGTGTCTCAGGT | 125 | N/A | N/A | 1527 |
| 949399 | 41061 | 41076 | CACAAGTAGCCTTGGC | 107 | N/A | N/A | 1528 |
| 949400 | 41107 | 41122 | TCACAGTGGACACCAG | 85 | N/A | N/A | 1529 |
| 949401 | 41162 | 41177 | TGACAGACCCCAAAGT | 121 | N/A | N/A | 1530 |
| 949402 | 41234 | 41249 | GAACAAGCTACATCAA | 100 | N/A | N/A | 1531 |
| 949403 | 41266 | 41281 | TGGAGAGGGTTCTCTG | 94 | N/A | N/A | 1532 |
| 949404 | 41272 | 41287 | GATAATTGGAGAGGGT | 84 | N/A | N/A | 1533 |
| 949405 | 41393 | 41408 | GCGAACCTTTCTCACT | 57 | N/A | N/A | 1534 |
| 949406 | 41447 | 41462 | AAACAGGATACGAGAC | 74 | N/A | N/A | 1535 |
| 949407 | 41451 | 41466 | GCACAAACAGGATACG | 86 | N/A | N/A | 1536 |
| 949408 | 41497 | 41512 | TAATCCCTTTCCGTCA | 92 | N/A | N/A | 1537 |
| 949409 | 41604 | 41619 | TGTCTTCGAGCCACAC | 99 | N/A | N/A | 1538 |
| 949410 | 41708 | 41723 | CCCTACAGACACTTGC | 101 | N/A | N/A | 1539 |
| 949411 | 41814 | 41829 | CCGTAGGCAGATTCCA | 62 | N/A | N/A | 1540 |
| 949412 | 41862 | 41877 | GCGAAACCAGAGAGAT | 88 | N/A | N/A | 1541 |
| 949413 | 41863 | 41878 | GGCGAAACCAGAGAGA | 86 | N/A | N/A | 1542 |
| 949414 | 41962 | 41977 | AGCTTTTAAACCCCCC | 87 | N/A | N/A | 1543 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949415 | 41984 | 41999 | AGCCAGATTATTAACA | 58 | N/A | N/A | 1544 |
| 949416 | 42064 | 42079 | GATGAGGAGGCTGGTC | 78 | N/A | N/A | 1545 |
| 949417 | 42169 | 42184 | ACGAAGACCCCCCAGG | 163 | N/A | N/A | 1546 |
| 949418 | 42203 | 42218 | CATGAGAAAAGGGATC | 97 | N/A | N/A | 1547 |
| 949419 | 42249 | 42264 | CAACAAGTCAGCCCAA | 100 | N/A | N/A | 1548 |
| 949420 | 42252 | 42267 | ACACAACAAGTCAGCC | 78 | N/A | N/A | 1549 |
| 949421 | 42254 | 42269 | CTACACAACAAGTCAG | 28 | N/A | N/A | 1550 |
| 949422 | 42318 | 42333 | TTCTAGCCCGTCAGCC | 90 | N/A | N/A | 1551 |
| 949423 | 42434 | 42449 | TTCCAGAAGACCTGTT | 143 | N/A | N/A | 1552 |
| 949424 | 42507 | 42522 | TAGCACTACAATCATT | 71 | N/A | N/A | 1553 |
| 949425 | 42544 | 42559 | AACGAGACAGCATCCT | 64 | N/A | N/A | 1554 |
| 949426 | 42577 | 42592 | GCAATTGGTACTGTAC | 101 | N/A | N/A | 1555 |
| 949427 | 42584 | 42599 | ACACAGGGCAATTGGT | 144 | N/A | N/A | 1556 |
| 949428 | 42727 | 42742 | TCGAACTCAACCTCAG | 70 | N/A | N/A | 1557 |
| 949429 | 42860 | 42875 | TGCCTCGGGTTCAAGC | 64 | N/A | N/A | 1558 |
| 949430 | 42983 | 42998 | TGAAAGGTTCTAGGCA | 64 | N/A | N/A | 1559 |
| 949431 | 42984 | 42999 | GTGAAAGGTTCTAGGC | 57 | N/A | N/A | 1560 |
| 949432 | 43017 | 43032 | TCGAAAGGAAATTCTG | 89 | N/A | N/A | 1561 |
| 949433 | 43028 | 43043 | ACATTAAAGGCTCGAA | 43 | N/A | N/A | 1562 |
| 949434 | 43030 | 43045 | GTACATTAAAGGCTCG | 59 | N/A | N/A | 1563 |
| 949435 | 43050 | 43065 | GTAGAAACAGTGGGCT | 61 | N/A | N/A | 1564 |
| 949436 | 43094 | 43109 | GTACACTCAGAAAGGA | 91 | N/A | N/A | 1565 |
| 949437 | 43141 | 43156 | GTGAATACACCAGGAT | 76 | N/A | N/A | 1566 |
| 949438 | 43194 | 43209 | ACTCAGGCACAACCAC | 123 | N/A | N/A | 1567 |
| 949439 | 43864 | 43879 | CGACAGAGCTGTTTAA | 47 | N/A | N/A | 1568 |
| 949440 | 43884 | 43899 | GCGGAATGTAAATTAC | 40 | N/A | N/A | 1569 |
| 949441 | 43918 | 43933 | CTAAAGACCACTAATT | 122 | N/A | N/A | 1570 |
| 949442 | 43920 | 43935 | GACTAAAGACCACTAA | 53 | N/A | N/A | 1571 |
| 949443 | 44005 | 44020 | GTACAGAGCCATGACT | 113 | N/A | N/A | 1572 |
| 949444 | 44161 | 44176 | TAAAGCCTGGACAAG | 77 | N/A | N/A | 1573 |
| 949445 | 44199 | 44214 | TACATCTGGACTATGG | 23 | N/A | N/A | 1574 |
| 949446 | 44271 | 44286 | GATACCTGGATGTGGG | 80 | N/A | N/A | 1575 |
| 949447 | 44336 | 44351 | GACAAAATAGGATGTG | 88 | N/A | N/A | 1576 |
| 949448 | 44351 | 44366 | AGGAAAGTTATTGATG | 63 | N/A | N/A | 1577 |
| 949449 | 44356 | 44371 | ATACGAGGAAAGTTAT | 112 | N/A | N/A | 1578 |
| 949450 | 44359 | 44374 | AAAATACGAGGAAAGT | 80 | N/A | N/A | 1579 |
| 949451 | 44362 | 44377 | GGTAAAATACGAGGAA | 23 | N/A | N/A | 1580 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949452 | 44375 | 44390 | CCACATGTATATGGGT | 85 | N/A | N/A | 1581 |
| 949453 | 44426 | 44441 | CCATACCCAGGAGATC | 57 | N/A | N/A | 1582 |
| 949454 | 44509 | 44524 | AACCATTTCCCTCTGG | 58 | N/A | N/A | 1583 |
| 949455 | 44624 | 44639 | GGCGACCTCAGCAAAG | 85 | N/A | N/A | 1584 |
| 949456 | 44732 | 44747 | AAGGAAGTCCCTGTGA | 106 | N/A | N/A | 1585 |
| 949457 | 44851 | 44866 | GGCAACCACACATCCA | 79 | N/A | N/A | 1586 |
| 949458 | 44953 | 44968 | ACTGAGCCGTTTTTCA | 42 | N/A | N/A | 1587 |
| 949459 | 45279 | 45294 | CCGAAGTGAGAGGGTC | 88 | N/A | N/A | 1588 |
| 949460 | 45364 | 45379 | CAAAATCGGGTTATCT | 66 | N/A | N/A | 1589 |
| 949461 | 45365 | 45380 | GCAAAATCGGGTTATC | 38 | N/A | N/A | 1590 |
| 949462 | 45412 | 45427 | AAGGATGGATGTGTCA | 18 | N/A | N/A | 1591 |
| 949463 | 45503 | 45518 | TGACATGCGGGAATGA | 40 | N/A | N/A | 1592 |
| 949464 | 45523 | 45538 | AGTAGAAACTGGGACG | 43 | N/A | N/A | 1593 |
| 949465 | 45570 | 45585 | AGCTATAAAACCAGCC | 106 | N/A | N/A | 1594 |
| 949466 | 45603 | 45618 | TACAAAAGAGTATAGC | 70 | N/A | N/A | 1595 |
| 949467 | 45705 | 45720 | CACCACTGCACGGCCT | 97 | N/A | N/A | 1596 |
| 949468 | 45850 | 45865 | AACATAACCCCCATCT | 88 | N/A | N/A | 1597 |
| 949469 | 45957 | 45972 | AGCAATGGTAGAGGGC | 113 | N/A | N/A | 1598 |
| 949470 | 46279 | 46294 | GCAATGGTGGCCGGGC | 96 | N/A | N/A | 1599 |
| 949471 | 46323 | 46338 | TTCAACAGGCTGGGTC | 44 | N/A | N/A | 1600 |
| 949472 | 46330 | 46345 | TACTATATTCAACAGG | 18 | N/A | N/A | 1601 |
| 949473 | 46344 | 46359 | CCACACATAGGCCATA | 35 | N/A | N/A | 1602 |
| 949474 | 46382 | 46397 | ATACACTGAGATCAGG | 50 | N/A | N/A | 1603 |
| 949475 | 46431 | 46446 | GCTGGGATATACGCCC | 98 | N/A | N/A | 1604 |
| 949476 | 46505 | 46520 | ACGGAGACCCTTACCT | 129 | N/A | N/A | 1605 |
| 949477 | 46528 | 46543 | TTGCAGATTAGCAGGG | 35 | N/A | N/A | 1606 |
| 949478 | 46560 | 46575 | ACAAACTGAGTGTTGA | 73 | N/A | N/A | 1607 |
| 949479 | 46562 | 46577 | ACACAAACTGAGTGTT | 78 | N/A | N/A | 1608 |
| 949480 | 46577 | 46592 | CGCAAGAAGACATTAA | 54 | N/A | N/A | 1609 |
| 949481 | 46666 | 46681 | GGCAGCATGGCTAAGC | 75 | N/A | N/A | 1610 |
| 949482 | 46764 | 46779 | ACGAAAGTGAGGAGTC | 66 | N/A | N/A | 1611 |
| 949483 | 46766 | 46781 | GGACGAAAGTGAGGAG | 15 | N/A | N/A | 1612 |
| 949484 | 46863 | 46878 | TACGAAATAGCAGAGC | 17 | N/A | N/A | 1613 |
| 949485 | 46885 | 46900 | GCCCATTGGCCCATCG | 154 | N/A | N/A | 1614 |
| 949486 | 47094 | 47109 | GATCACCCGCCACTGT | 105 | N/A | N/A | 1615 |
| 949487 | 47352 | 47367 | CACCAGGGACTCATTA | 124 | N/A | N/A | 1616 |

TABLE 3-continued

| | | | DNM2 mRNA Expression | | | |
|---|---|---|---|---|---|---|
| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949488 | 47466 | 47481 | ACACAGTGGTGGTCCC | 59 | N/A | N/A | 1617 |
| 949489 | 47517 | 47532 | TGCTTTAAGGCTAACA | 82 | N/A | N/A | 1618 |
| 949490 | 47599 | 47614 | GGCCTGCGCTCTGTGC | 87 | N/A | N/A | 1619 |
| 949491 | 47700 | 47715 | TGCCCTAAGGCAAGTG | 91 | N/A | N/A | 1620 |
| 949492 | 47797 | 47812 | CAACAGCCACAGGATC | 77 | N/A | N/A | 1621 |
| 949493 | 47803 | 47818 | TTCCACCAACAGCCAC | 25 | N/A | N/A | 1622 |
| 949494 | 47924 | 47939 | AACTATGCATCCACCT | 122 | N/A | N/A | 1623 |
| 949495 | 47927 | 47942 | TGCAACTATGCATCCA | 130 | N/A | N/A | 1624 |
| 949496 | 48220 | 48235 | GGCTAGGTGGTGTGCG | 116 | N/A | N/A | 1625 |
| 949497 | 48501 | 48516 | GAGATTGGAGCCTGGT | 33 | N/A | N/A | 1626 |
| 949498 | 48506 | 48521 | AATAAGAGATTGGAGC | 89 | N/A | N/A | 1627 |
| 949499 | 48507 | 48522 | CAATAAGAGATTGGAG | 69 | N/A | N/A | 1628 |
| 949500 | 48508 | 48523 | GCAATAAGAGATTGGA | 13 | N/A | N/A | 1629 |
| 949501 | 48622 | 48637 | GTGAATCCAACAGACA | 70 | N/A | N/A | 1630 |
| 949502 | 48748 | 48763 | CAACATGCCTTCCAGT | 124 | N/A | N/A | 1631 |
| 949503 | 48869 | 48884 | TGCCACTCCCTATCCC | 79 | N/A | N/A | 1632 |
| 949504 | 48972 | 48987 | GCTTAATGCCTTGCCT | 128 | N/A | N/A | 1633 |
| 949505 | 49052 | 49067 | CCGCAATGTGTTCATT | 42 | N/A | N/A | 1634 |
| 949506 | 49095 | 49110 | GTATACCCCACAAGGC | 73 | N/A | N/A | 1635 |
| 949507 | 49171 | 49186 | GTAAAGGGTGGCAGCC | 84 | N/A | N/A | 1636 |
| 949508 | 49196 | 49211 | AGTCACTTTAACAAGT | 57 | N/A | N/A | 1637 |
| 949509 | 49218 | 49233 | GCTACCAAGGCACAGA | 72 | N/A | N/A | 1638 |
| 949510 | 49265 | 49280 | CATGGCCACGATGGCA | 92 | N/A | N/A | 1639 |
| 949511 | 49297 | 49312 | GAAGAGACAGCATACC | 69 | N/A | N/A | 1640 |
| 949512 | 49403 | 49418 | AGTTATGGTTCACTGG | 29 | N/A | N/A | 1641 |
| 949513 | 49511 | 49526 | ACTCAGAGTTTACGGG | 91 | N/A | N/A | 1642 |
| 949514 | 49613 | 49628 | TTCCGGTGAGCACACC | 49 | N/A | N/A | 1643 |
| 949515 | 49770 | 49785 | GAATCAGGAGGGAGAT | 101 | N/A | N/A | 1644 |
| 949516 | 49888 | 49903 | GGCAAGTGACCAGGTG | 55 | N/A | N/A | 1645 |
| 949517 | 49896 | 49911 | ACGAAGGCGGCAAGTG | 6 | N/A | N/A | 1646 |
| 949518 | 50269 | 50284 | GCAGAGAGAGTCCATT | 38 | N/A | N/A | 1647 |
| 949519 | 50271 | 50286 | GCGCAGAGAGAGTCCA | 116 | N/A | N/A | 1648 |
| 949520 | 50402 | 50417 | GCCCAGTAGGCAAGAA | 117 | N/A | N/A | 1649 |
| 949521 | 50423 | 50438 | AAGTAACCCCCATCAC | 94 | N/A | N/A | 1650 |
| 949522 | 50491 | 50506 | CTAGATACAAGGCTGC | 62 | N/A | N/A | 1651 |
| 949523 | 50510 | 50525 | CGCCAGCTTGGTCTGC | 70 | N/A | N/A | 1652 |
| 949524 | 50597 | 50612 | ACGCAAATATCTCCCA | 41 | N/A | N/A | 1653 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949525 | 50612 | 50627 | CTAATCCGAGGCAATA | 59 | N/A | N/A | 1654 |
| 949526 | 50654 | 50669 | GCACACAACACTTCCC | 41 | N/A | N/A | 1655 |
| 949527 | 50713 | 50728 | GGCAGGATCCACTCAT | 111 | N/A | N/A | 1656 |
| 949528 | 50818 | 50833 | AGGAGAGGAGATCTGC | 87 | N/A | N/A | 1657 |
| 949529 | 50847 | 50862 | ACACAATGACGAGGCT | 27 | N/A | N/A | 1658 |
| 949530 | 50945 | 50960 | TGTTAGTCTCAGGGAA | 54 | N/A | N/A | 1659 |
| 949531 | 50961 | 50976 | ACAAACACGGCTCAGC | 77 | N/A | N/A | 1660 |
| 949532 | 51078 | 51093 | CGACACCCAGCTCCGG | 95 | N/A | N/A | 1661 |
| 949533 | 51207 | 51222 | TTGAAATGCCCAGGTC | 37 | N/A | N/A | 1662 |
| 949534 | 51318 | 51333 | TTCAAAGGAGCTTGTG | 100 | N/A | N/A | 1663 |
| 949535 | 51433 | 51448 | TGCAAGCTGCCACCTT | 79 | N/A | N/A | 1664 |
| 949536 | 51496 | 51511 | TGCTAAACAGTCAATC | 62 | N/A | N/A | 1665 |
| 949537 | 51544 | 51559 | AACCTAGGAGGACATC | 62 | N/A | N/A | 1666 |
| 949538 | 51660 | 51675 | CCCTACTGAAGCTGGA | 71 | N/A | N/A | 1667 |
| 949539 | 51787 | 51802 | AATCACGCTGCCAAGG | 112 | N/A | N/A | 1668 |
| 949540 | 51890 | 51905 | TCAGAGAGGTTCGCAG | 57 | N/A | N/A | 1669 |
| 949541 | 51993 | 52008 | CGGCAAACTGCAAAGC | 67 | N/A | N/A | 1670 |
| 949542 | 52114 | 52129 | CAACAAGCCACTGAGC | 108 | N/A | N/A | 1671 |
| 949543 | 52204 | 52219 | TAACAATCCACTGGCC | 116 | N/A | N/A | 1672 |
| 949544 | 52243 | 52258 | GCTCAAGTGCTGGAGA | 89 | N/A | N/A | 1673 |
| 949545 | 52494 | 52509 | CAAGATCCTACATGTA | 79 | N/A | N/A | 1674 |
| 949546 | 52597 | 52612 | TAAAAGCTTCCACCAG | 119 | N/A | N/A | 1675 |
| 949547 | 52610 | 52625 | CCCAATAGAGGTTTAA | 100 | N/A | N/A | 1676 |
| 949548 | 52802 | 52817 | TCTCATACTTCGGCCT | 111 | N/A | N/A | 1677 |
| 949549 | 52918 | 52933 | CAACAGAGGTTTTTG | 67 | N/A | N/A | 1678 |
| 949550 | 52944 | 52959 | GTGAAAGTAAATGCTG | 48 | N/A | N/A | 1679 |
| 949551 | 53030 | 53045 | AACAGAACCACACCAG | 216 | N/A | N/A | 1680 |
| 949552 | 53066 | 53081 | CCAGAAAACCGTTTCT | 93 | N/A | N/A | 1681 |
| 949553 | 53509 | 53524 | ATGCAGGCTGGGAACC | 88 | N/A | N/A | 1682 |
| 949554 | 53548 | 53563 | TGCCAGACTTTGGAGC | 92 | N/A | N/A | 1683 |
| 949555 | 53611 | 53626 | CCCAAGTCCGCCCAGT | 90 | N/A | N/A | 1684 |
| 949556 | 53712 | 53727 | CTGAATCTAGGTGTCT | 54 | N/A | N/A | 1685 |
| 949557 | 53847 | 53862 | CTTGAATGTCCATGCC | 60 | N/A | N/A | 1686 |
| 949558 | 53863 | 53878 | ATATAGAGAGCTTTAC | 104 | N/A | N/A | 1687 |
| 949559 | 53866 | 53881 | CTAATATAGAGAGCTT | 51 | N/A | N/A | 1688 |
| 949560 | 53867 | 53882 | TCTAATATAGAGAGCT | 78 | N/A | N/A | 1689 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949561 | 53909 | 53924 | CCCCATAACACTTACT | 98 | N/A | N/A | 1690 |
| 949562 | 54006 | 54021 | AGCTACTCTCTCAAGT | 53 | N/A | N/A | 1691 |
| 949563 | 54011 | 54026 | GGGCAAGCTACTCTCT | 126 | N/A | N/A | 1692 |
| 949564 | 54127 | 54142 | AGCTACGGTCTGAGCA | 114 | N/A | N/A | 1693 |
| 949565 | 54237 | 54252 | AGTCAGAGGGCCTGCC | 58 | N/A | N/A | 1694 |
| 949566 | 54341 | 54356 | GCTCACTTTGGATTGT | 48 | N/A | N/A | 1695 |
| 949567 | 54452 | 54467 | GTCTACAAAGCCCAGC | 67 | N/A | N/A | 1696 |
| 949568 | 54562 | 54577 | AAAGAGACCATCTCCC | 91 | N/A | N/A | 1697 |
| 949569 | 54673 | 54688 | GGGAAACACTCGGCCG | 142 | N/A | N/A | 1698 |
| 949570 | 54784 | 54799 | CAATGAGGACATCTGC | 59 | N/A | N/A | 1699 |
| 949571 | 54787 | 54802 | GGGCAATGAGGACATC | 54 | N/A | N/A | 1700 |
| 949572 | 54890 | 54905 | AGGAACTTCGCCTCTT | 112 | N/A | N/A | 1701 |
| 949573 | 54924 | 54939 | TCCTAAGCCAGATAGC | 49 | N/A | N/A | 1702 |
| 949574 | 55043 | 55058 | TCTAAGATCCCCATTT | 106 | N/A | N/A | 1703 |
| 949575 | 55144 | 55159 | TTTCACCGTCCCATCA | 72 | N/A | N/A | 1704 |
| 949576 | 55247 | 55262 | AATAACACAGCCATGC | 84 | N/A | N/A | 1705 |
| 949577 | 55348 | 55363 | ACCCACCCCGGAGATG | 100 | N/A | N/A | 1706 |
| 949578 | 55383 | 55398 | TAATAAGTCACACTGG | 47 | N/A | N/A | 1707 |
| 949579 | 55384 | 55399 | GTAATAAGTCACACTG | 107 | N/A | N/A | 1708 |
| 949580 | 55469 | 55484 | CTATGATCTATGATCA | 115 | N/A | N/A | 1709 |
| 949581 | 55678 | 55693 | TCCGTATAAGATGTGA | 34 | N/A | N/A | 1710 |
| 949582 | 56054 | 56069 | CTATTATCCAGCACTG | 56 | N/A | N/A | 1711 |
| 949583 | 56111 | 56126 | AGCTACTGTAGTGATG | 81 | N/A | N/A | 1712 |
| 949584 | 56167 | 56182 | TCGAATTTTCAGAGTA | 26 | N/A | N/A | 1713 |
| 949585 | 56229 | 56244 | ACGGAAGGTGGCTGCC | 61 | N/A | N/A | 1714 |
| 949586 | 56251 | 56266 | GCAAATATAAGGCATG | 60 | N/A | N/A | 1715 |
| 949587 | 56268 | 56283 | CACAGATTGAGGACAA | 47 | N/A | N/A | 1716 |
| 949588 | 56319 | 56334 | TGACAAGCAGTGTGGG | 48 | N/A | N/A | 1717 |
| 949589 | 56371 | 56386 | GGTATCTGAAAGTCAC | 9 | N/A | N/A | 1718 |
| 949590 | 56530 | 56545 | CCACAAGGTAGAGGGA | 154 | N/A | N/A | 1719 |
| 949591 | 56538 | 56553 | CAAGGAGCCCACAAGG | 114 | N/A | N/A | 1720 |
| 949592 | 56633 | 56648 | GCCCAAGTCCTTGTGG | 105 | N/A | N/A | 1721 |
| 949593 | 56691 | 56706 | GATTAAGGTGATGCTG | 61 | N/A | N/A | 1722 |
| 949594 | 56692 | 56707 | TGATTAAGGTGATGCT | 41 | N/A | N/A | 1723 |
| 949595 | 56734 | 56749 | AGGAAGCACCAGGATA | 23 | N/A | N/A | 1724 |
| 949596 | 56860 | 56875 | CATATTATGAATCCCC | 66 | N/A | N/A | 1725 |
| 949597 | 56863 | 56878 | TGACATATTATGAATC | 105 | N/A | N/A | 1726 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949598 | 56979 | 56994 | ATGACAAGGGTCTTGG | 17 | N/A | N/A | 1727 |
| 949599 | 57373 | 57388 | TAATGACCCAGGCTGG | 121 | N/A | N/A | 1728 |
| 949600 | 57619 | 57634 | GCCTACCGTGTGGCGA | 104 | N/A | N/A | 1729 |
| 949601 | 57654 | 57669 | CCAGAAACGGTCAGTG | 132 | N/A | N/A | 1730 |
| 949602 | 57722 | 57737 | TGTGAATGGGCACATG | 102 | N/A | N/A | 1731 |
| 949603 | 57840 | 57855 | CAAACAACTTCTTGGC | 82 | N/A | N/A | 1732 |
| 949604 | 57948 | 57963 | GAAGACTGGTTCTGGC | 60 | N/A | N/A | 1733 |
| 949605 | 57953 | 57968 | TTACAGAAGACTGGTT | 91 | N/A | N/A | 1734 |
| 949606 | 58891 | 58906 | GGCAAGGTGGCTAAAA | 123 | N/A | N/A | 1735 |
| 949607 | 58993 | 59008 | AGGAACCCATCATGGT | 95 | N/A | N/A | 1736 |
| 949608 | 59092 | 59107 | TGACAAGGTAGGTTTT | 57 | N/A | N/A | 1737 |
| 949609 | 59093 | 59108 | TTGACAAGGTAGGTTT | 25 | N/A | N/A | 1738 |
| 949610 | 59102 | 59117 | CAAAACTGGTTGACAA | 47 | N/A | N/A | 1739 |
| 949611 | 59104 | 59119 | TGCAAAACTGGTTGAC | 58 | N/A | N/A | 1740 |
| 949612 | 59272 | 59287 | GTGAAGTGCAGTAGCT | 88 | N/A | N/A | 1741 |
| 949613 | 59302 | 59317 | TAAGATAGAGGGTCTT | 35 | N/A | N/A | 1742 |
| 949614 | 59399 | 59414 | GCTAACAATTTAAGGA | 60 | N/A | N/A | 1743 |
| 949615 | 59741 | 59756 | CTGAGAGGCATACAAA | 66 | N/A | N/A | 1744 |
| 949616 | 59846 | 59861 | GGAGAAGAAGTGAGCC | 109 | N/A | N/A | 1745 |
| 949617 | 60067 | 60082 | ACAAATGGATGAGGCC | 129 | N/A | N/A | 1746 |
| 949618 | 60068 | 60083 | GACAAATGGATGAGGC | 54 | N/A | N/A | 1747 |
| 949619 | 60379 | 60394 | GACAAACAGATGAGGC | 74 | N/A | N/A | 1748 |
| 949620 | 60427 | 60442 | GAATAAATTTCAGCCC | 100 | N/A | N/A | 1749 |
| 949621 | 60483 | 60498 | TTCAATGGCACAGTTC | 73 | N/A | N/A | 1750 |
| 949622 | 60586 | 60601 | TCAGACTTGAGGATGT | 32 | N/A | N/A | 1751 |
| 949623 | 60639 | 60654 | GCACAAACAGGCCCGC | 99 | N/A | N/A | 1752 |
| 949624 | 60700 | 60715 | GTCAAGTTCAACACTG | 25 | N/A | N/A | 1753 |
| 949625 | 60903 | 60918 | GCTCAGGGTTACCTTG | 81 | N/A | N/A | 1754 |
| 949626 | 61033 | 61048 | AGGAAGTGCCATGTTC | 64 | N/A | N/A | 1755 |
| 949627 | 61134 | 61149 | TCCCACTCTGGCAACA | 79 | N/A | N/A | 1756 |
| 949628 | 61204 | 61219 | AGCTAGATGGGACCTA | 102 | N/A | N/A | 1757 |
| 949629 | 61255 | 61270 | GAAGTTCCCGTTCTGA | 47 | N/A | N/A | 1758 |
| 949630 | 61336 | 61351 | AAATAGACGATCTCAC | 87 | N/A | N/A | 1759 |
| 949631 | 61340 | 61355 | AGGGAAATAGACGATC | 96 | N/A | N/A | 1760 |
| 949632 | 61344 | 61359 | TCGAAGGGAAATAGAC | 101 | N/A | N/A | 1761 |
| 949633 | 61382 | 61397 | GTAGAAGGATCTGACT | 114 | N/A | N/A | 1762 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949634 | 61384 | 61399 | CAGTAGAAGGATCTGA | 123 | N/A | N/A | 1763 |
| 949635 | 61480 | 61495 | GTGAAGATCTCTGGTG | 88 | N/A | N/A | 1764 |
| 949636 | 61485 | 61500 | CCAGAGTGAAGATCTC | 119 | N/A | N/A | 1765 |
| 949637 | 61587 | 61602 | CTGCAGATCAACTGCT | 104 | N/A | N/A | 1766 |
| 949638 | 61636 | 61651 | CCACAAGTCATTCCAG | 71 | N/A | N/A | 1767 |
| 949639 | 61706 | 61721 | TTCCAGGACTACCTCT | 76 | N/A | N/A | 1768 |
| 949640 | 61813 | 61828 | GGCTTTGGGAAACCTC | 48 | N/A | N/A | 1769 |
| 949641 | 61839 | 61854 | TATTAAGGACAACCTC | 98 | N/A | N/A | 1770 |
| 949642 | 61840 | 61855 | TTATTAAGGACAACCT | 81 | N/A | N/A | 1771 |
| 949643 | 61842 | 61857 | TGTTATTAAGGACAAC | 125 | N/A | N/A | 1772 |
| 949644 | 61889 | 61904 | TGGCACACGGCAAATA | 96 | N/A | N/A | 1773 |
| 949645 | 61904 | 61919 | TCATAAGGGTGAGCCT | 70 | N/A | N/A | 1774 |
| 949646 | 61915 | 61930 | TCACAGGGTGGTCATA | 68 | N/A | N/A | 1775 |
| 949647 | 61937 | 61952 | GAAGATGGTCACAGCC | 51 | N/A | N/A | 1776 |
| 949648 | 61944 | 61959 | GTCGAATGAAGATGGT | 38 | N/A | N/A | 1777 |
| 949649 | 62105 | 62120 | GGCCTGAAAGAGCCCA | 112 | N/A | N/A | 1778 |
| 949650 | 62252 | 62267 | GATAAGGACCCCACCC | 108 | N/A | N/A | 1779 |
| 949651 | 62328 | 62343 | AAAGAAGGAGTTACGG | 88 | N/A | N/A | 1780 |
| 949652 | 62378 | 62393 | ACGAATGCATACAAAT | 72 | N/A | N/A | 1781 |
| 949653 | 62384 | 62399 | TGAAAAACGAATGCAT | 107 | N/A | N/A | 1782 |
| 949654 | 62491 | 62506 | CACCAGTGGCTGTCTG | 63 | N/A | N/A | 1783 |
| 949655 | 62887 | 62902 | TCATAATAGGCCGGGT | 61 | N/A | N/A | 1784 |
| 949656 | 62969 | 62984 | ATAATAACCACCGAAG | 45 | N/A | N/A | 1785 |
| 949657 | 62972 | 62987 | ATAATAATAACCACCG | 13 | N/A | N/A | 1786 |
| 949658 | 63350 | 63365 | CCTAGGATTTGTGTTA | 101 | N/A | N/A | 1787 |
| 949659 | 63667 | 63682 | GCCTAGGATTTATAGA | 96 | N/A | N/A | 1788 |
| 949660 | 63759 | 63774 | CCACAAATGAATGGTA | 72 | N/A | N/A | 1789 |
| 949661 | 63780 | 63795 | TGGGATGTGGTCTGGT | 98 | N/A | N/A | 1790 |
| 949662 | 63826 | 63841 | CTAATTACCAGCTAAC | 46 | N/A | N/A | 1791 |
| 949663 | 63880 | 63895 | ACTTAGGTTACTCCTA | 76 | N/A | N/A | 1792 |
| 949664 | 64255 | 64270 | AACTGCTGCTCCGATA | 53 | N/A | N/A | 1793 |
| 949665 | 64313 | 64328 | GGCTATAGGGCTGATA | 104 | N/A | N/A | 1794 |
| 949666 | 64366 | 64381 | AAATGCACCGCTCTGC | 137 | N/A | N/A | 1795 |
| 949667 | 64530 | 64545 | ACAGAATAAGACATCG | 55 | N/A | N/A | 1796 |
| 949668 | 64650 | 64665 | AGCAATCGCACATGCC | 92 | N/A | N/A | 1797 |
| 949669 | 64984 | 64999 | AGTAGATGCCAGAGGG | 54 | N/A | N/A | 1798 |
| 949670 | 65026 | 65041 | GGCTAAGCATGAAGGG | 96 | N/A | N/A | 1799 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949671 | 65086 | 65101 | ATCTATCTCAGACATC | 110 | N/A | N/A | 1800 |
| 949672 | 65109 | 65124 | CCAAGGTCTGAACTTT | 69 | N/A | N/A | 1801 |
| 949673 | 65111 | 65126 | AACCAAGGTCTGAACT | 125 | N/A | N/A | 1802 |
| 949674 | 65112 | 65127 | CAACCAAGGTCTGAAC | 110 | N/A | N/A | 1803 |
| 949675 | 65113 | 65128 | GCAACCAAGGTCTGAA | 31 | N/A | N/A | 1804 |
| 949676 | 65115 | 65130 | TGGCAACCAAGGTCTG | 67 | N/A | N/A | 1805 |
| 949677 | 65116 | 65131 | CTGGCAACCAAGGTCT | 120 | N/A | N/A | 1806 |
| 949678 | 65117 | 65132 | GCTGGCAACCAAGGTC | 156 | N/A | N/A | 1807 |
| 949679 | 65119 | 65134 | ATGCTGGCAACCAAGG | 40 | N/A | N/A | 1808 |
| 949680 | 65192 | 65207 | GAATTTAGCCCTGACA | 94 | N/A | N/A | 1809 |
| 949681 | 65208 | 65223 | AGCTAAACAGGGTTTT | 78 | N/A | N/A | 1810 |
| 949682 | 65343 | 65358 | GTCCAAGGGCAGCCGG | 100 | N/A | N/A | 1811 |
| 949683 | 65383 | 65398 | CCCCAAAGGCCCTTAG | 97 | N/A | N/A | 1812 |
| 949684 | 65458 | 65473 | GTGGACATCAGTGAGT | 53 | N/A | N/A | 1813 |
| 949685 | 65527 | 65542 | CTACAAGTGAGCTGAG | 6 | N/A | N/A | 1814 |
| 949686 | 65543 | 65558 | CAAAACGGGAGCAGGC | 83 | N/A | N/A | 1815 |
| 949687 | 65544 | 65559 | ACAAAACGGGAGCAGG | 51 | N/A | N/A | 1816 |
| 949688 | 65545 | 65560 | CACAAAACGGGAGCAG | 76 | N/A | N/A | 1817 |
| 949689 | 65583 | 65598 | AAAAAGGGTCCAGTGG | 91 | N/A | N/A | 1818 |
| 949690 | 65599 | 65614 | TCATTAGTACGCCAGG | 24 | N/A | N/A | 1819 |
| 949691 | 65686 | 65701 | CCCAACTGTGCTTTCC | 26 | N/A | N/A | 1820 |
| 949692 | 66037 | 66052 | TCACACACGGATTTTT | 73 | N/A | N/A | 1821 |
| 949693 | 66148 | 66163 | TTCTGCATTGCAGTGG | 26 | N/A | N/A | 1822 |
| 949694 | 66218 | 66233 | GTAAAAAGCATCTGGC | 83 | N/A | N/A | 1823 |
| 949695 | 66272 | 66287 | GCCAGAGTCACCATCA | 73 | N/A | N/A | 1824 |
| 949696 | 66327 | 66342 | TGCCAAGGTGAGGTCA | 91 | N/A | N/A | 1825 |
| 949697 | 66373 | 66388 | CGCCAGATCTCTCTTG | 104 | N/A | N/A | 1826 |
| 949698 | 66787 | 66802 | TGCCTACCATTGCACT | 86 | N/A | N/A | 1827 |
| 949699 | 66882 | 66897 | CGAGAAGGAGGTAGAA | 82 | N/A | N/A | 1828 |
| 949700 | 66890 | 66905 | AACTACACCGAGAAGG | 101 | N/A | N/A | 1829 |
| 949701 | 66895 | 66910 | TCCAAAACTACACCGA | 72 | N/A | N/A | 1830 |
| 949702 | 66973 | 66988 | ATCAAACGAGTATATT | 91 | N/A | N/A | 1831 |
| 949703 | 66974 | 66989 | TATCAAACGAGTATAT | 101 | N/A | N/A | 1832 |
| 949704 | 66987 | 67002 | AGCTAAAATCCACTAT | 110 | N/A | N/A | 1833 |
| 949705 | 66998 | 67013 | CAATAGGGAAGAGCTA | 57 | N/A | N/A | 1834 |
| 949706 | 66999 | 67014 | GCAATAGGGAAGAGCT | 117 | N/A | N/A | 1835 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949707 | 67000 | 67015 | AGCAATAGGGAAGAGC | 75 | N/A | N/A | 1836 |
| 949708 | 67377 | 67392 | ATCAAGACTCTGAATA | 86 | N/A | N/A | 1837 |
| 949709 | 67669 | 67684 | TTCAAAGATAGGTGAG | 32 | N/A | N/A | 1838 |
| 949710 | 67762 | 67777 | CATTAAGTATTTGGAG | 77 | N/A | N/A | 1839 |
| 949711 | 67770 | 67785 | AAGAGCAACATTAAGT | 111 | N/A | N/A | 1840 |
| 949712 | 67773 | 67788 | GCGAAGAGCAACATTA | 120 | N/A | N/A | 1841 |
| 949713 | 67793 | 67808 | TGCGAATGCACATGGC | 138 | N/A | N/A | 1842 |
| 949714 | 67803 | 67818 | ACACAGAGGGTGCGAA | 153 | N/A | N/A | 1843 |
| 949715 | 67805 | 67820 | CAACACAGAGGGTGCG | 47 | N/A | N/A | 1844 |
| 949716 | 67823 | 67838 | TAACATGTTACTCAGA | 75 | N/A | N/A | 1845 |
| 949717 | 67870 | 67885 | TCAAGTATAGAGATGG | 46 | N/A | N/A | 1846 |
| 949718 | 68110 | 68125 | AGTACCTGATTCAGCG | 147 | N/A | N/A | 1847 |
| 949719 | 68180 | 68195 | TGCCAGTGAGGATTGC | 56 | N/A | N/A | 1848 |
| 949720 | 68210 | 68225 | AAAACAAGTGCTGCTC | 77 | N/A | N/A | 1849 |
| 949721 | 68491 | 68506 | GAATCAAGTACATTTC | 77 | N/A | N/A | 1850 |
| 949722 | 68541 | 68556 | GTAATAGTAGCAGCAC | 29 | N/A | N/A | 1851 |
| 949723 | 68542 | 68557 | TGTAATAGTAGCAGCA | 20 | N/A | N/A | 1852 |
| 949724 | 68610 | 68625 | GTCTTCTGGGTAAATG | 30 | N/A | N/A | 1853 |
| 949725 | 68624 | 68639 | AGGCAATGCATACAGT | 25 | N/A | N/A | 1854 |
| 949726 | 68992 | 69007 | GAACGATAGGCCAGGC | 90 | N/A | N/A | 1855 |
| 949727 | 68999 | 69014 | AAGAAGAGAACGATAG | 67 | N/A | N/A | 1856 |
| 949728 | 69029 | 69044 | GTTTATGCACCATGTG | 20 | N/A | N/A | 1857 |
| 949729 | 69102 | 69117 | AAAACAGCGAGGAGGA | 90 | N/A | N/A | 1858 |
| 949730 | 69108 | 69123 | TGCTAGAAAACAGCGA | 109 | N/A | N/A | 1859 |
| 949731 | 69206 | 69221 | CAGGAACCTACTCTCG | 86 | N/A | N/A | 1860 |
| 949732 | 69213 | 69228 | ACAAGGACAGGAACCT | 97 | N/A | N/A | 1861 |
| 949733 | 69215 | 69230 | CTACAAGGACAGGAAC | 107 | N/A | N/A | 1862 |
| 949734 | 69361 | 69376 | CTAGACACTGACTTCC | 89 | N/A | N/A | 1863 |
| 949735 | 69486 | 69501 | GGCCAGCTGGACTTTT | 74 | N/A | N/A | 1864 |
| 949736 | 69589 | 69604 | TACTAGGGCACTTAAG | 149 | N/A | N/A | 1865 |
| 949737 | 69591 | 69606 | GATACTAGGGCACTTA | 69 | N/A | N/A | 1866 |
| 949738 | 69692 | 69707 | ACCAAGGGTCCCTGCC | 113 | N/A | N/A | 1867 |
| 949739 | 69781 | 69796 | TACAAAGTGTCTGGCG | 53 | N/A | N/A | 1868 |
| 949740 | 69782 | 69797 | ATACAAAGTGTCTGGC | 41 | N/A | N/A | 1869 |
| 949741 | 70034 | 70049 | GATTAGGAGACAAGCC | 87 | N/A | N/A | 1870 |
| 949742 | 70467 | 70482 | ATCCATTCTGGACAAC | 62 | N/A | N/A | 1871 |
| 949743 | 70664 | 70679 | CACTAGAGGATAGGCG | 118 | N/A | N/A | 1872 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949744 | 70759 | 70774 | GTAAAGCAGAGTTTGG | 25 | N/A | N/A | 1873 |
| 949745 | 70760 | 70775 | TGTAAAGCAGAGTTTG | 46 | N/A | N/A | 1874 |
| 949746 | 70766 | 70781 | GCAAAGTGTAAAGCAG | 53 | N/A | N/A | 1875 |
| 949747 | 70787 | 70802 | CCATAAAATCAGCCTA | 71 | N/A | N/A | 1876 |
| 949748 | 70897 | 70912 | AAAGAACTCGGGAGGT | 65 | N/A | N/A | 1877 |
| 949749 | 71020 | 71035 | TTAAGATCAAGAGATC | 115 | N/A | N/A | 1878 |
| 949750 | 71155 | 71170 | TCAAGATGAGCTCCCC | 65 | N/A | N/A | 1879 |
| 949751 | 71255 | 71270 | GTCCATCCAGACCACG | 119 | N/A | N/A | 1880 |
| 949752 | 71260 | 71275 | GGACAGTCCATCCAGA | 84 | N/A | N/A | 1881 |
| 949753 | 71369 | 71384 | GGAGACGGCACGGAGC | 81 | N/A | N/A | 1882 |
| 949754 | 71371 | 71386 | ACGGAGACGGCACGGA | 87 | N/A | N/A | 1883 |
| 949755 | 71473 | 71488 | ACCAAGGGCCAACACC | 70 | N/A | N/A | 1884 |
| 949756 | 71697 | 71712 | ACATACTGCAGCAGGG | 52 | N/A | N/A | 1885 |
| 949757 | 71797 | 71812 | AATCAATGAGTGGACG | 29 | N/A | N/A | 1886 |
| 949758 | 71827 | 71842 | ACGCAGAAGGCTTGCA | 87 | N/A | N/A | 1887 |
| 949759 | 71908 | 71923 | CCATTCTGAGCACTCC | 41 | N/A | N/A | 1888 |
| 949760 | 72021 | 72036 | TCTAAAGGAGGCTGTT | 82 | N/A | N/A | 1889 |
| 949761 | 72175 | 72190 | AGCCTAATTTTGCAAT | 133 | N/A | N/A | 1890 |
| 949762 | 72938 | 72953 | GGCCAACACTCATCTT | 128 | N/A | N/A | 1891 |
| 949763 | 73188 | 73203 | TGATATGCAGTGACAC | 75 | N/A | N/A | 1892 |
| 949764 | 73296 | 73311 | TCCCACACGGCTCCTG | 144 | N/A | N/A | 1893 |
| 949765 | 73415 | 73430 | GCACAACCTGCTCTAT | 80 | N/A | N/A | 1894 |
| 949766 | 73519 | 73534 | GAGCACCTGAGTCAGT | 91 | N/A | N/A | 1895 |
| 949767 | 73639 | 73654 | ACCAACCAAGTCATGG | 137 | N/A | N/A | 1896 |
| 949768 | 73653 | 73668 | AGCTAAGCAGCTGCAC | 133 | N/A | N/A | 1897 |
| 949769 | 73742 | 73757 | TTACAGGCCAAAAGCC | 88 | N/A | N/A | 1898 |
| 949770 | 73868 | 73883 | GAGGAGGCGGTGTCCT | 122 | N/A | N/A | 1899 |
| 949771 | 73954 | 73969 | CATAAAAGCACTCTGG | 87 | N/A | N/A | 1900 |
| 949772 | 73957 | 73972 | GAGCATAAAAGCACTC | 92 | N/A | N/A | 1901 |
| 949773 | 73970 | 73985 | GTCAAGGCTGTCTGAG | 56 | N/A | N/A | 1902 |
| 949774 | 74231 | 74246 | GCTGAATCTTGTGTTT | 47 | N/A | N/A | 1903 |
| 949775 | 74259 | 74274 | CACAACAACACTTCCT | 73 | N/A | N/A | 1904 |
| 949776 | 74351 | 74366 | CTTTAGAGGTGCAGAA | 53 | N/A | N/A | 1905 |
| 949777 | 74592 | 74607 | ATCCACTGAAGCCTCT | 50 | N/A | N/A | 1906 |
| 949778 | 74872 | 74887 | CTTAACAAGTAGTATT | 14 | N/A | N/A | 1907 |
| 949779 | 74874 | 74889 | GGCTTAACAAGTAGTA | 38 | N/A | N/A | 1908 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949780 | 74962 | 74977 | GGCAACTGGTTACAAA | 58 | N/A | N/A | 1909 |
| 949781 | 74967 | 74982 | TGCAAGGCAACTGGTT | 14 | N/A | N/A | 1910 |
| 949782 | 75001 | 75016 | CTCCATGGTGAGAGTG | 73 | N/A | N/A | 1911 |
| 949783 | 75055 | 75070 | GCTAAAGCAAGAAGGC | 87 | N/A | N/A | 1912 |
| 949784 | 75104 | 75119 | AGAAAGACCGCCCATG | 97 | N/A | N/A | 1913 |
| 949785 | 75219 | 75234 | GCGGAGACAGAAGGCT | 121 | N/A | N/A | 1914 |
| 949786 | 75320 | 75335 | AAGCATCGGTTAAGGC | 142 | N/A | N/A | 1915 |
| 949787 | 75846 | 75861 | CCCAAGTGGTGAGGCT | 74 | N/A | N/A | 1916 |
| 949788 | 76007 | 76022 | GTTCAGGCAGGCGGTT | 53 | N/A | N/A | 1917 |
| 949789 | 76107 | 76122 | AACAAGAGACCTTGTC | 47 | N/A | N/A | 1918 |
| 949790 | 76211 | 76226 | GATCAGGCTACTCAGG | 116 | N/A | N/A | 1919 |
| 949791 | 76415 | 76430 | TCATAGCCAATATAAC | 42 | N/A | N/A | 1920 |
| 949792 | 76430 | 76445 | TATCACAGGGTGTGCT | 67 | N/A | N/A | 1921 |
| 949793 | 76487 | 76502 | TCGGAATGTACTCTTA | 23 | N/A | N/A | 1922 |
| 949794 | 76518 | 76533 | GAATTCGGGTTGAATC | 107 | N/A | N/A | 1923 |
| 949795 | 76636 | 76651 | GACAAAGCACACCTGG | 81 | N/A | N/A | 1924 |
| 949796 | 76637 | 76652 | GGACAAAGCACACCTG | 100 | N/A | N/A | 1925 |
| 949797 | 76731 | 76746 | CACTAAACTAATGACA | 98 | N/A | N/A | 1926 |
| 949798 | 76734 | 76749 | TAGCACTAAACTAATG | 88 | N/A | N/A | 1927 |
| 949799 | 76737 | 76752 | GCATAGCACTAAACTA | 83 | N/A | N/A | 1928 |
| 949800 | 76739 | 76754 | AGGCATAGCACTAAAC | 80 | N/A | N/A | 1929 |
| 949801 | 76744 | 76759 | AGCAAAGGCATAGCAC | 91 | N/A | N/A | 1930 |
| 949802 | 76764 | 76779 | ACCAAACCAGGACCAA | 57 | N/A | N/A | 1931 |
| 949803 | 77124 | 77139 | GTTAATGCTTCACCTG | 25 | N/A | N/A | 1932 |
| 949804 | 77125 | 77140 | GGTTAATGCTTCACCT | 104 | N/A | N/A | 1933 |
| 949805 | 77175 | 77190 | GTAAAGGGTGTGCACA | 10 | N/A | N/A | 1934 |
| 949806 | 77224 | 77239 | AGGCAAGCACAAGCTG | 115 | N/A | N/A | 1935 |
| 949807 | 77245 | 77260 | CCTTCATACCCCAACT | 97 | N/A | N/A | 1936 |
| 949808 | 77343 | 77358 | TACTGAAGTACCTGGG | 102 | N/A | N/A | 1937 |
| 949809 | 77421 | 77436 | TCCTAAGCATTCCTAA | 113 | N/A | N/A | 1938 |
| 949810 | 77450 | 77465 | GTAGGATGATCTTGTT | 27 | N/A | N/A | 1939 |
| 949811 | 77458 | 77473 | GTAAAAAGTAGGATG | 68 | N/A | N/A | 1940 |
| 949812 | 77502 | 77517 | CCTTAAAAAGAGTCTC | 75 | N/A | N/A | 1941 |
| 949813 | 77561 | 77576 | GCTCATCTAATGGACA | 46 | N/A | N/A | 1942 |
| 949814 | 77634 | 77649 | GGCGAGACAGAGTAAG | 12 | N/A | N/A | 1943 |
| 949815 | 77894 | 77909 | TATACTGGACACGGTG | 96 | N/A | N/A | 1944 |
| 949816 | 77895 | 77910 | ATATACTGGACACGGT | 88 | N/A | N/A | 1945 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID: 2 Stop Site | SEQ ID NO |
|---|---|---|---|---|---|---|---|
| 949817 | 77897 | 77912 | ATATATACTGGACACG | 36 | N/A | N/A | 1946 |
| 949818 | 78035 | 78050 | GTTTTATTGGCCGGGT | 20 | N/A | N/A | 1947 |
| 949819 | 78144 | 78159 | AGTCACTGATCCTAAA | 74 | N/A | N/A | 1948 |
| 949820 | 78149 | 78164 | CAAGAAGTCACTGATC | 69 | N/A | N/A | 1949 |
| 949821 | 78222 | 78237 | ACAAAATGGGTTGAGG | 38 | N/A | N/A | 1950 |
| 949822 | 78223 | 78238 | TACAAAATGGGTTGAG | 50 | N/A | N/A | 1951 |
| 949823 | 78262 | 78277 | GGACAGGACTTTGCCC | 119 | N/A | N/A | 1952 |
| 949824 | 78348 | 78363 | CCACAATTCAGGTGGC | 122 | N/A | N/A | 1953 |
| 949825 | 78366 | 78381 | GGAAAGGTAGCCACTT | 64 | N/A | N/A | 1954 |
| 949826 | 78470 | 78485 | GCCCACTTATTCCTCC | 120 | N/A | N/A | 1955 |
| 949827 | 78561 | 78576 | CCAAATTCAAGAGCTC | 45 | N/A | N/A | 1956 |
| 949828 | 78611 | 78626 | TACCATTTTCAGCAG | 25 | N/A | N/A | 1957 |
| 949829 | 78678 | 78693 | TCAAAACGGAGGTTTC | 20 | N/A | N/A | 1958 |
| 949830 | 78711 | 78726 | GACCATCCTATGAGGA | 106 | N/A | N/A | 1959 |
| 949831 | 78878 | 78893 | GACCAGAGACGGGAGG | 58 | N/A | N/A | 1960 |
| 949832 | 78949 | 78964 | GCCTAGAGGTAGGAGC | 64 | N/A | N/A | 1961 |
| 949833 | 78961 | 78976 | CCACAAGTTCAGGCCT | 107 | N/A | N/A | 1962 |
| 949834 | 79024 | 79039 | TCAAAGCTGAGTGTCA | 25 | N/A | N/A | 1963 |
| 949835 | 79143 | 79158 | TGCTAGGGACATCTTC | 17 | N/A | N/A | 1964 |
| 949836 | 79212 | 79227 | GTATATATCAGCTCAG | 30 | N/A | N/A | 1965 |
| 949837 | 79225 | 79240 | ACATAAGGATGTTGTA | 126 | N/A | N/A | 1966 |
| 949838 | 79243 | 79258 | ATCCATGTTCAGTTTC | 13 | N/A | N/A | 1967 |
| 949839 | 79330 | 79345 | CGGAAAAAGAAGTCCC | 154 | N/A | N/A | 1968 |
| 949840 | 79375 | 79390 | TTCAAGCAAATCACAC | 96 | N/A | N/A | 1969 |
| 949841 | 79794 | 79809 | TCAGTATGCACCACCA | 6 | N/A | N/A | 1970 |
| 949842 | 79870 | 79885 | AAGCATGACATGACAC | 16 | N/A | N/A | 1971 |
| 949843 | 80250 | 80265 | CAGAATATTTAACTCG | 26 | N/A | N/A | 1972 |
| 949844 | 80347 | 80362 | GACAAACCAAGCACAT | 107 | N/A | N/A | 1973 |
| 949845 | 80435 | 80450 | GTGGAACTTGCCTGAC | 86 | N/A | N/A | 1974 |
| 949846 | 80542 | 80557 | TCCAAGAGCCCTCTTA | 11 | N/A | N/A | 1975 |
| 949847 | 80662 | 80677 | CCTATTTGATCAGGAG | 137 | N/A | N/A | 1976 |
| 949848 | 80759 | 80774 | TGATTCAGTGCCGCCC | 7 | N/A | N/A | 1977 |
| 949849 | 80769 | 80784 | CCCAAAACCCTGATTC | 17 | N/A | N/A | 1978 |
| 949850 | 80805 | 80820 | TCACGAGGAAGCCATG | 54 | N/A | N/A | 1979 |
| 949851 | 80870 | 80885 | GGCGATGGAAGGGCAG | 57 | N/A | N/A | 1980 |
| 949852 | 80981 | 80996 | TTTCATTGGCCCTGGC | 62 | N/A | N/A | 1981 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949853 | 80987 | 81002 | CAGCAATTTCATTGGC | 63 | N/A | N/A | 1982 |
| 949854 | 81187 | 81202 | TACCTTACTGGTACAC | 67 | N/A | N/A | 1983 |
| 949855 | 81200 | 81215 | GCCGAGGGAGCAATAC | 102 | N/A | N/A | 1984 |
| 949856 | 81201 | 81216 | TGCCGAGGGAGCAATA | 49 | N/A | N/A | 1985 |
| 949857 | 81288 | 81303 | GAAAAGGCACCAGTGG | 39 | N/A | N/A | 1986 |
| 949858 | 81306 | 81321 | CACAAAGCGATATGGG | 7 | N/A | N/A | 1987 |
| 949859 | 81411 | 81426 | GTGCATCTGTCTGGCC | 79 | N/A | N/A | 1988 |
| 949860 | 81445 | 81460 | TGCTAGGCTTGGTATC | 95 | N/A | N/A | 1989 |
| 949861 | 81530 | 81545 | CAGCAGTTGACGCGGG | 127 | N/A | N/A | 1990 |
| 949862 | 81635 | 81650 | CCGGAGCTGAGGGACA | 117 | N/A | N/A | 1991 |
| 949863 | 81738 | 81753 | AAAAATGGGCTGCCCC | 103 | N/A | N/A | 1992 |
| 949864 | 81740 | 81755 | CCAAAAATGGGCTGCC | 90 | N/A | N/A | 1993 |
| 949865 | 81752 | 81767 | GACTAAGTGGATCCAA | 2 | N/A | N/A | 1994 |
| 949866 | 81769 | 81784 | GCGCATAGAGGCACTG | 56 | N/A | N/A | 1995 |
| 949867 | 81845 | 81860 | AACCAGGCCCGCGGCG | 90 | N/A | N/A | 1996 |
| 949868 | 81909 | 81924 | GCGCAAGCACAGACTG | 109 | N/A | N/A | 1997 |
| 949869 | 81953 | 81968 | GCAGAAATTCCCTGGC | 92 | N/A | N/A | 1998 |
| 949870 | 82004 | 82019 | AGCTTAAGCAGCAAAT | 111 | N/A | N/A | 1999 |
| 949871 | 82041 | 82056 | TTTGGACTGTTTTCCC | 8 | N/A | N/A | 2000 |
| 949872 | 82043 | 82058 | TGTTTGGACTGTTTTC | 2 | N/A | N/A | 2001 |
| 949873 | 82044 | 82059 | CTGTTTGGACTGTTTT | 1 | N/A | N/A | 2002 |
| 949874 | 82045 | 82060 | CCTGTTTGGACTGTTT | 1 | N/A | N/A | 2003 |
| 949875 | 82047 | 82062 | AACCTGTTTGGACTGT | 4 | N/A | N/A | 2004 |
| 949876 | 82048 | 82063 | CAACCTGTTTGGACTG | 5 | N/A | N/A | 2005 |
| 949877 | 82050 | 82065 | TCCAACCTGTTTGGAC | 27 | N/A | N/A | 2006 |
| 949878 | 82052 | 82067 | TTTCCAACCTGTTTGG | 44 | N/A | N/A | 2007 |
| 949879 | 82053 | 82068 | TTTTCCAACCTGTTTG | 17 | N/A | N/A | 2008 |
| 949880 | 82054 | 82069 | GTTTTCCAACCTGTTT | 4 | N/A | N/A | 2009 |
| 949881 | 82084 | 82099 | ATGTCCATGACACCTG | 17 | N/A | N/A | 2010 |
| 949882 | 82085 | 82100 | CATGTCCATGACACCT | 39 | N/A | N/A | 2011 |
| 949883 | 82087 | 82102 | TTCATGTCCATGACAC | 30 | N/A | N/A | 2012 |
| 949884 | 82089 | 82104 | CATTCATGTCCATGAC | 13 | N/A | N/A | 2013 |
| 949885 | 82091 | 82106 | AACATTCATGTCCATG | 51 | N/A | N/A | 2014 |
| 949886 | 82154 | 82169 | TACAGAAGGGCCACGG | 6 | N/A | N/A | 2015 |
| 949887 | 82155 | 82170 | TTACAGAAGGGCCACG | 10 | N/A | N/A | 2016 |
| 949888 | 82259 | 82274 | GATTAGTCCATGCATG | 99 | N/A | N/A | 2017 |
| 949889 | 82308 | 82323 | ACACACGCAGGACAGG | 85 | N/A | N/A | 2018 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949890 | 82361 | 82376 | GGTCATGCGGAGGGCA | 41 | N/A | N/A | 2019 |
| 949891 | 82509 | 82524 | TGTTACCTTCTCGGCA | 19 | N/A | N/A | 2020 |
| 949892 | 82529 | 82544 | GCGGAGATGAGAACAA | 13 | N/A | N/A | 2021 |
| 949893 | 82619 | 82634 | CTGGTAGGCGGAAGGG | 77 | N/A | N/A | 2022 |
| 949894 | 82632 | 82647 | CTCTAAGTGACAACTG | 18 | N/A | N/A | 2023 |
| 949895 | 82720 | 82735 | AACAAAGGCTGACCGC | 85 | N/A | N/A | 2024 |
| 949896 | 82827 | 82842 | GATGATGTGTTTCCTG | 1 | N/A | N/A | 2025 |
| 949897 | 82836 | 82851 | GGCTATACAGATGATG | 7 | N/A | N/A | 2026 |
| 949898 | 82948 | 82963 | AACCAGACCTCATGCA | 22 | N/A | N/A | 2027 |
| 949899 | 82953 | 82968 | AACTTAACCAGACCTC | 12 | N/A | N/A | 2028 |
| 949900 | 82994 | 83009 | CGCCAAATGCCCCCAC | 29 | N/A | N/A | 2029 |
| 949901 | 83049 | 83064 | GATAGGAACTCCTTGC | 48 | N/A | N/A | 2030 |
| 949902 | 83051 | 83066 | TCGATAGGAACTCCTT | 96 | N/A | N/A | 2031 |
| 949903 | 83124 | 83139 | CTGAAGGGCCTCGCCA | 119 | N/A | N/A | 2032 |
| 949904 | 83183 | 83198 | TGCCATGCAGGGCTTC | 74 | N/A | N/A | 2033 |
| 949905 | 83283 | 83298 | GTGGACCGGAGACAGC | 125 | N/A | N/A | 2034 |
| 949906 | 83399 | 83414 | TAGAAAATGCGGAGGG | 91 | N/A | N/A | 2035 |
| 949907 | 83424 | 83439 | CGGGAAGCAACATGAA | 77 | N/A | N/A | 2036 |
| 949908 | 83429 | 83444 | TGGCACGGGAAGCAAC | 87 | N/A | N/A | 2037 |
| 949909 | 83464 | 83479 | GAACAAGCAGAGTGGT | 51 | N/A | N/A | 2038 |
| 949910 | 83566 | 83581 | GGCCAGTACCTGGTCC | 103 | N/A | N/A | 2039 |
| 949911 | 83622 | 83637 | GAACAGTACACTTGAC | 90 | N/A | N/A | 2040 |
| 949912 | 83627 | 83642 | GCACAGAACAGTACAC | 100 | N/A | N/A | 2041 |
| 949942 | 83908 | 83923 | GGTTGACTACAAAGGG | 5 | N/A | N/A | 2042 |
| 949943 | 83909 | 83924 | AGGTTGACTACAAAGG | 3 | N/A | N/A | 2043 |
| 949944 | 83911 | 83926 | AGAGGTTGACTACAAA | 4 | N/A | N/A | 2044 |
| 949945 | 83912 | 83927 | GAGAGGTTGACTACAA | 2 | N/A | N/A | 2045 |
| 949946 | 83914 | 83929 | TTGAGAGGTTGACTAC | 66 | N/A | N/A | 2046 |
| 949947 | 83916 | 83931 | TTTTGAGAGGTTGACT | 21 | N/A | N/A | 2047 |
| 949948 | 83918 | 83933 | GTTTTTGAGAGGTTGA | 2 | N/A | N/A | 2048 |
| 949949 | 83919 | 83934 | GGTTTTTGAGAGGTTG | 3 | N/A | N/A | 2049 |
| 949950 | 83920 | 83935 | GGGTTTTTGAGAGGTT | 5 | N/A | N/A | 2050 |
| 949951 | 83922 | 83937 | GTGGGTTTTTGAGAGG | 17 | N/A | N/A | 2051 |
| 949952 | 83923 | 83938 | TGTGGGTTTTTGAGAG | 25 | N/A | N/A | 2052 |
| 949953 | 83924 | 83939 | CTGTGGGTTTTTGAGA | 38 | N/A | N/A | 2053 |
| 949954 | 83926 | 83941 | GCCTGTGGGTTTTTGA | 24 | N/A | N/A | 2054 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949955 | 84164 | 84179 | CCATAACTTACTGAAG | 69 | N/A | N/A | 2055 |
| 949956 | 84276 | 84291 | GTAGGATAGGGAGCGG | 31 | N/A | N/A | 2056 |
| 949957 | 84379 | 84394 | TCCCAAATGCAGACGC | 38 | N/A | N/A | 2057 |
| 949958 | 84397 | 84412 | ACAAACAACACGCTTG | 88 | N/A | N/A | 2058 |
| 949959 | 84399 | 84414 | CAACAAACAACACGCT | 88 | N/A | N/A | 2059 |
| 949960 | 84687 | 84702 | AATTAGGTGGGTAAAG | 64 | N/A | N/A | 2060 |
| 949961 | 84860 | 84875 | GCCTTTGCAAGAAAGC | 94 | N/A | N/A | 2061 |
| 949962 | 85204 | 85219 | GGTTTCAACAAACAGT | 11 | N/A | N/A | 2062 |
| 949963 | 85243 | 85258 | AACAAAGTGACATAGC | 8 | N/A | N/A | 2063 |
| 949964 | 85260 | 85275 | GGAGAGGGACCATTTT | 94 | N/A | N/A | 2064 |
| 949965 | 85323 | 85338 | AATCAAAACTGGGCGC | 100 | N/A | N/A | 2065 |
| 949966 | 85335 | 85350 | AGCAATTGGCCAAATC | 55 | N/A | N/A | 2066 |
| 949967 | 85362 | 85377 | GGCATAGGTGGACTGG | 21 | N/A | N/A | 2067 |
| 949968 | 85379 | 85394 | AGCTACAGCAGCTATG | 83 | N/A | N/A | 2068 |
| 949969 | 85438 | 85453 | CTTACCAACAGTAACA | 67 | N/A | N/A | 2069 |
| 949970 | 85541 | 85556 | GGCTGGTTTAGTAAGG | 75 | N/A | N/A | 2070 |
| 949971 | 85608 | 85623 | GGGCAAGGCACTCGGA | 54 | N/A | N/A | 2071 |
| 949972 | 85618 | 85633 | GAATAAAGTAGGGCAA | 44 | N/A | N/A | 2072 |
| 949973 | 85681 | 85696 | CGTCACTGGACTCCCC | 75 | N/A | N/A | 2073 |
| 949974 | 85784 | 85799 | CCAGGATGAAGTTGGT | 94 | N/A | N/A | 2074 |
| 949975 | 85876 | 85891 | ATCAAGCTAGAAAGGT | 19 | N/A | N/A | 2075 |
| 949976 | 85880 | 85895 | AGCTATCAAGCTAGAA | 82 | N/A | N/A | 2076 |
| 949977 | 85884 | 85899 | CTCAAGCTATCAAGCT | 120 | N/A | N/A | 2077 |
| 949978 | 85946 | 85961 | CCAATTATGAACACTA | 7 | N/A | N/A | 2078 |
| 949979 | 85984 | 85999 | GTTCAAAGTGTTGCAT | 9 | N/A | N/A | 2079 |
| 949980 | 86329 | 86344 | AGCCACTGCCTTGTAT | 74 | N/A | N/A | 2080 |
| 949981 | 86547 | 86562 | AATCATAGCCTCAAAC | 85 | N/A | N/A | 2081 |
| 949982 | 86551 | 86566 | GAACAATCATAGCCTC | 14 | N/A | N/A | 2082 |
| 949983 | 86933 | 86948 | AATAATGTGCAGTTGT | 14 | N/A | N/A | 2083 |
| 949984 | 87041 | 87056 | CCCCAAGGTCTGGAGT | 104 | N/A | N/A | 2084 |
| 949985 | 87160 | 87175 | TCCCAGACAGGAGAAC | 80 | N/A | N/A | 2085 |
| 949986 | 87349 | 87364 | ACCTACTTGGCAAACC | 128 | N/A | N/A | 2086 |
| 949987 | 87359 | 87374 | CTCTAAAAGTACCTAC | 127 | N/A | N/A | 2087 |
| 949988 | 87456 | 87471 | CGACAGAGACTGTCTG | 130 | N/A | N/A | 2088 |
| 949989 | 87574 | 87589 | CTAAACTAACCATGGG | 79 | N/A | N/A | 2089 |
| 949990 | 87595 | 87610 | GAACATAGCACTGCCC | 3 | N/A | N/A | 2090 |
| 949991 | 87597 | 87612 | CTGAACATAGCACTGC | 3 | N/A | N/A | 2091 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949992 | 87598 | 87613 | TCTGAACATAGCACTG | 9 | N/A | N/A | 2092 |
| 949993 | 87680 | 87695 | GCACACTGGTCGCTAA | 43 | N/A | N/A | 2093 |
| 949994 | 87782 | 87797 | TTGAAGCTAGGGAGAC | 85 | N/A | N/A | 2094 |
| 949995 | 87817 | 87832 | ACGGAAGGTTCTGGTT | 69 | N/A | N/A | 2095 |
| 949996 | 87880 | 87895 | GCACACTGAATCGACA | 23 | N/A | N/A | 2096 |
| 949997 | 87882 | 87897 | ACGCACACTGAATCGA | 43 | N/A | N/A | 2097 |
| 949998 | 87893 | 87908 | TGCCTGAGACCACGCA | 152 | N/A | N/A | 2098 |
| 949999 | 88002 | 88017 | TACCAGCGGCACCACC | 72 | N/A | N/A | 2099 |
| 950000 | 88014 | 88029 | AGCGAGAGGGCATACC | 30 | N/A | N/A | 2100 |
| 950001 | 88119 | 88134 | CACTACACCTTAACGC | 70 | N/A | N/A | 2101 |
| 950002 | 88226 | 88241 | CTCTAGAGGCCCTCCC | 98 | N/A | N/A | 2102 |
| 950003 | 88271 | 88286 | CACCGATAAATGTTGT | 27 | N/A | N/A | 2103 |
| 950004 | 88308 | 88323 | CAGCACGGAACAGATC | 51 | N/A | N/A | 2104 |
| 950005 | 88397 | 88412 | AGGGACTTCGGCTCAT | 120 | N/A | N/A | 2105 |
| 950006 | 88497 | 88512 | GCAAACCAAAGATGGG | 47 | N/A | N/A | 2106 |
| 950007 | 88619 | 88634 | GGTAAGTGGGAAGGCC | 73 | N/A | N/A | 2107 |
| 950008 | 88766 | 88781 | CCCCGTAGCTCTTCAG | 24 | N/A | N/A | 2108 |
| 950009 | 88878 | 88893 | TTTAAGGACTCCACCT | 86 | N/A | N/A | 2109 |
| 950010 | 88992 | 89007 | TGGCATCACCTGACTT | 99 | N/A | N/A | 2110 |
| 950011 | 89116 | 89131 | ATCCAAAATCCTCCCC | 43 | N/A | N/A | 2111 |
| 950012 | 89192 | 89207 | TCAAATAGCAGCCCAC | 38 | N/A | N/A | 2112 |
| 950013 | 89231 | 89246 | CCTAAGGGCCTCCTGG | 102 | N/A | N/A | 2113 |
| 950014 | 89335 | 89350 | CACAAGAAGGATTTTC | 2 | N/A | N/A | 2114 |
| 950015 | 89459 | 89474 | CAGCAATCGACCCACC | 31 | N/A | N/A | 2115 |
| 950016 | 89560 | 89575 | GCTGAGATTACGCACC | 38 | N/A | N/A | 2116 |
| 950017 | 89706 | 89721 | CTTATCTGGGCTATTT | 7 | N/A | N/A | 2117 |
| 950018 | 89719 | 89734 | TATTATAGGGCTTCTT | 20 | N/A | N/A | 2118 |
| 950019 | 89813 | 89828 | GAAAGTAGGCTTCTGT | 6 | N/A | N/A | 2119 |
| 950020 | 89966 | 89981 | TGTTACTTATCCATCA | 7 | N/A | N/A | 2120 |
| 950021 | 89980 | 89995 | CAACATATATCTCCTG | 8 | N/A | N/A | 2121 |
| 950022 | 90075 | 90090 | ACAAATCCCACTATAT | 58 | N/A | N/A | 2122 |
| 950023 | 90081 | 90096 | GCATAGACAAATCCCA | 3 | N/A | N/A | 2123 |
| 950024 | 90175 | 90190 | CGACAGGGTGTGTTTC | 6 | N/A | N/A | 2124 |
| 950025 | 90197 | 90212 | AAATTTAGAGGACATC | 38 | N/A | N/A | 2125 |
| 950026 | 90276 | 90291 | AGCCATCCAGTCTTAG | 38 | N/A | N/A | 2126 |
| 950027 | 90541 | 90556 | CTCAAGTAGTTCCCCT | 12 | N/A | N/A | 2127 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 950028 | 90642 | 90657 | CACTAGAATCCCGGAG | 18 | N/A | N/A | 2128 |
| 950029 | 90673 | 90688 | ACTTACTAAAGCGCAG | 24 | N/A | N/A | 2129 |
| 950030 | 90722 | 90737 | AGTAAATGTATCTGGT | 3 | N/A | N/A | 2130 |
| 950031 | 90754 | 90769 | GCGCAAGGGAAACGGC | 97 | N/A | N/A | 2131 |
| 950032 | 90804 | 90819 | TGAGCAGCCACAGGTA | 31 | N/A | N/A | 2132 |
| 950033 | 90806 | 90821 | AGTGAGCAGCCACAGG | 45 | N/A | N/A | 2133 |
| 950034 | 90807 | 90822 | AAGTGAGCAGCCACAG | 83 | N/A | N/A | 2134 |
| 950035 | 90808 | 90823 | CAAGTGAGCAGCCACA | 27 | N/A | N/A | 2135 |
| 950036 | 90810 | 90825 | ACCAAGTGAGCAGCCA | 14 | N/A | N/A | 2136 |
| 950037 | 90812 | 90827 | GGACCAAGTGAGCAGC | 54 | N/A | N/A | 2137 |
| 950038 | 90837 | 90852 | GCGAATGTGGCCGTTC | 64 | N/A | N/A | 2138 |
| 950039 | 90889 | 90904 | GAACAGACAGGGTTCA | 97 | N/A | N/A | 2139 |
| 950040 | 90978 | 90993 | CGGGAGACTGCAGAGG | 44 | N/A | N/A | 2140 |
| 950041 | 91083 | 91098 | AGCAGATGGCCTGGTA | 18 | N/A | N/A | 2141 |
| 950042 | 91189 | 91204 | ACATAGGGCCTTCTGG | 38 | N/A | N/A | 2142 |
| 950043 | 91226 | 91241 | AGCCAAGAGTCAAGTT | 36 | N/A | N/A | 2143 |
| 950044 | 91384 | 91399 | CATGAGCCCACCACTC | 120 | N/A | N/A | 2144 |
| 950045 | 91538 | 91553 | CTCCTAACATGCTAGA | 75 | N/A | N/A | 2145 |
| 950046 | 91825 | 91840 | CGCTCAAGGGAAAAAT | 25 | N/A | N/A | 2146 |
| 950047 | 91934 | 91949 | TCCCAAGCTCCCCTGA | 51 | N/A | N/A | 2147 |
| 950048 | 92034 | 92049 | GATACAGCCGTTCATA | 11 | N/A | N/A | 2148 |
| 950049 | 92059 | 92074 | TAATAAGGTACTGAAG | 54 | N/A | N/A | 2149 |
| 950050 | 92634 | 92649 | ACGAAGCTAGGAGGCG | 108 | N/A | N/A | 2150 |
| 950051 | 92635 | 92650 | CACGAAGCTAGGAGGC | 35 | N/A | N/A | 2151 |
| 950052 | 92814 | 92829 | GCATGATAATCCCAGC | 98 | N/A | N/A | 2152 |
| 950053 | 93110 | 93125 | AGCCGCCCAGGCCAGA | 96 | N/A | N/A | 2153 |
| 950054 | 93183 | 93198 | GCAGAAATTTTGCGAA | 35 | N/A | N/A | 2154 |
| 950055 | 93185 | 93200 | AGGCAGAAATTTTGCG | 48 | N/A | N/A | 2155 |
| 950056 | 93235 | 93250 | GGTGGAGTCCCCGCCC | 165 | N/A | N/A | 2156 |
| 950057 | 93248 | 93263 | GTGCAAGGTACATGGT | 11 | N/A | N/A | 2157 |
| 950058 | 93303 | 93318 | CGCAAAAATAAATCAT | 83 | N/A | N/A | 2158 |
| 950059 | 93304 | 93319 | GCGCAAAAATAAATCA | 105 | N/A | N/A | 2159 |
| 950060 | 93322 | 93337 | ATGTATTACCTACGGC | 7 | N/A | N/A | 2160 |
| 950061 | 93383 | 93398 | CATATTCATGGTGTTA | 10 | N/A | N/A | 2161 |
| 950062 | 93496 | 93511 | AGAGATGGAAGGGACG | 89 | N/A | N/A | 2162 |
| 950063 | 93586 | 93601 | CCACACTAAGCATGTA | 38 | N/A | N/A | 2163 |
| 950064 | 93600 | 93615 | TCTAATGTTTGCTACC | 7 | N/A | N/A | 2164 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 950065 | 93601 | 93616 | CTCTAATGTTTGCTAC | 4 | N/A | N/A | 2165 |
| 950066 | 93612 | 93627 | ACCACTAGATTCTCTA | 56 | N/A | N/A | 2166 |
| 950067 | 93648 | 93663 | GAACAGGGAATATTAG | 79 | N/A | N/A | 2167 |
| 950068 | 93744 | 93759 | TTATACCCAGGGCAAC | 37 | N/A | N/A | 2168 |
| 950069 | 93854 | 93869 | TAAGTATTTGCCATCC | 6 | N/A | N/A | 2169 |
| 950070 | 93908 | 93923 | GCTTAAGCGAGATCTT | 42 | N/A | N/A | 2170 |
| 950071 | 93921 | 93936 | GAATTCTGGTCTGGCT | 26 | N/A | N/A | 2171 |
| 950072 | 93958 | 93973 | CATAGGAGATAGAAGG | 4 | N/A | N/A | 2172 |
| 950073 | 93960 | 93975 | TGCATAGGAGATAGAA | 34 | N/A | N/A | 2173 |
| 950074 | 94019 | 94034 | CACAAGAGGGCAAGAT | 36 | N/A | N/A | 2174 |
| 950075 | 94050 | 94065 | TGCTAGATCAACTAGC | 7 | N/A | N/A | 2175 |
| 950076 | 94058 | 94073 | GCAAAGAGTGCTAGAT | 89 | N/A | N/A | 2176 |
| 950077 | 94060 | 94075 | AGGCAAAGAGTGCTAG | 78 | N/A | N/A | 2177 |
| 950078 | 94065 | 94080 | GCACAAGGCAAAGAGT | 89 | N/A | N/A | 2178 |
| 950079 | 94078 | 94093 | TGCTAGAGGAGCGGCA | 114 | N/A | N/A | 2179 |
| 950080 | 94153 | 94168 | CTATAGAACAGGAGTG | 15 | N/A | N/A | 2180 |
| 950081 | 94155 | 94170 | TGCTATAGAACAGGAG | 9 | N/A | N/A | 2181 |
| 950082 | 94164 | 94179 | AGCCACATCTGCTATA | 89 | N/A | N/A | 2182 |
| 950083 | 94176 | 94191 | CCTTAATCACTTAGCC | 7 | N/A | N/A | 2183 |
| 950084 | 94200 | 94215 | TATCATATAGGGAGAA | 16 | N/A | N/A | 2184 |
| 950085 | 94215 | 94230 | GCATAGAGAAGAGGGT | 6 | N/A | N/A | 2185 |
| 950086 | 94270 | 94285 | GACAAGAGGCAGCATC | 7 | N/A | N/A | 2186 |
| 950087 | 94333 | 94348 | TCACAGGCCAAGGATA | 81 | N/A | N/A | 2187 |
| 950088 | 94371 | 94386 | TGGCAGGAAACGGTGC | 42 | N/A | N/A | 2188 |
| 950089 | 94450 | 94465 | GCAAATATGATTCATC | 1 | N/A | N/A | 2189 |
| 950090 | 94481 | 94496 | AAGGAGGTGTTACCCA | 60 | N/A | N/A | 2190 |
| 950091 | 94581 | 94596 | CTATGAGTAGCAGGCT | 3 | N/A | N/A | 2191 |
| 950092 | 94652 | 94667 | GTCCAAGTGTAAGAGC | 12 | N/A | N/A | 2192 |
| 950093 | 94695 | 94710 | GCAAAAGGGAGCCCCT | 69 | N/A | N/A | 2193 |
| 950094 | 94696 | 94711 | AGCAAAAGGGAGCCCC | 88 | N/A | N/A | 2194 |
| 950095 | 94770 | 94785 | TGCCAGAAGAGCCCCG | 84 | N/A | N/A | 2195 |
| 950096 | 94791 | 94806 | CTACAAGAAAGACCCT | 30 | N/A | N/A | 2196 |
| 950097 | 94805 | 94820 | TAGGATCGGCTCAGCT | 18 | N/A | N/A | 2197 |
| 950098 | 94810 | 94825 | TGGCATAGGATCGGCT | 54 | N/A | N/A | 2198 |
| 950099 | 94920 | 94935 | GAACACATGAGGAACC | 24 | N/A | N/A | 2199 |
| 950100 | 94977 | 94992 | GTACAAGGGAGAAGCA | 100 | N/A | N/A | 2200 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 950101 | 95047 | 95062 | GGCCACGCTCATGACG | 97 | N/A | N/A | 2201 |
| 950102 | 95086 | 95101 | GTAGAGATGGGAACCA | 4 | N/A | N/A | 2202 |
| 950103 | 95155 | 95170 | AAGCAGGGATCCTCTG | 114 | N/A | N/A | 2203 |
| 950104 | 95189 | 95204 | GCGGTATGGGTGGCAG | 106 | N/A | N/A | 2204 |
| 950105 | 95227 | 95242 | GGCTAGGGTGCACAGT | 60 | N/A | N/A | 2205 |
| 950106 | 95278 | 95293 | CTTAGAAGGAAGTAGG | 100 | N/A | N/A | 2206 |
| 950107 | 95378 | 95393 | CCGTTAGCCATCCACC | 73 | N/A | N/A | 2207 |
| 950108 | 95416 | 95431 | CCCTAGGGAGCTGCAA | 112 | N/A | N/A | 2208 |
| 950109 | 95443 | 95458 | CCACACGGGTTCAGAG | 43 | N/A | N/A | 2209 |
| 950110 | 95496 | 95511 | GCACACCAAGCCTTGG | 63 | N/A | N/A | 2210 |
| 950111 | 95645 | 95660 | AGGGATGTGCCCGCAC | 87 | N/A | N/A | 2211 |
| 950112 | 95745 | 95760 | TGACAACCAGGTGAGG | 24 | N/A | N/A | 2212 |
| 950113 | 95854 | 95869 | TGGGAATGCCTCCATT | 95 | N/A | N/A | 2213 |
| 950114 | 95954 | 95969 | AGCCCTGTGAGGTCA | 66 | N/A | N/A | 2214 |
| 950115 | 96079 | 96094 | GTACAGACTTATCCCT | 28 | N/A | N/A | 2215 |
| 950116 | 96081 | 96096 | GGGTACAGACTTATCC | 95 | N/A | N/A | 2216 |
| 950117 | 96178 | 96193 | GGCTAAAGAGTACCCA | 63 | N/A | N/A | 2217 |
| 950118 | 96181 | 96196 | GGTGGCTAAAGAGTAC | 23 | N/A | N/A | 2218 |
| 950119 | 96298 | 96313 | GACTACCCCGACCCAC | 71 | N/A | N/A | 2219 |
| 950120 | 96399 | 96414 | GCACGGCACGGCAGGA | 24 | N/A | N/A | 2220 |
| 950121 | 96523 | 96538 | ACGCACAGGGCGGCCT | 111 | N/A | N/A | 2221 |
| 950122 | 96527 | 96542 | AGGCACGCACAGGGCG | 83 | N/A | N/A | 2222 |
| 950123 | 96646 | 96661 | CTAACGGCAGGCAGCC | 71 | N/A | N/A | 2223 |
| 950124 | 96752 | 96767 | CATCAGGGTTTCAGGC | 11 | N/A | N/A | 2224 |
| 950125 | 96860 | 96875 | GGCTAGGGTCAAAGGT | 21 | N/A | N/A | 2225 |
| 950126 | 96977 | 96992 | GCCCATGGGAGGAGTC | 80 | N/A | N/A | 2226 |
| 950127 | 97078 | 97093 | GAAACCAACATGAGGC | 20 | N/A | N/A | 2227 |
| 950128 | 97149 | 97164 | CGCAATAGAGACACCT | 32 | N/A | N/A | 2228 |
| 950129 | 97221 | 97236 | GAACCTCGCTCCGTGC | 165 | N/A | N/A | 2229 |
| 950130 | 97453 | 97468 | AGTGACTGAGTTCTGC | 22 | N/A | N/A | 2230 |
| 950131 | 97809 | 97824 | GGTTACGGTTGTTTTT | 26 | N/A | N/A | 2231 |
| 950132 | 97855 | 97870 | GTACAATGTAAGCCTT | 3 | N/A | N/A | 2232 |
| 950133 | 97920 | 97935 | TGCTAGTGACTCCATC | 27 | N/A | N/A | 2233 |
| 950134 | 98046 | 98061 | AGTGATGGAACCCCGG | 48 | N/A | N/A | 2234 |
| 950135 | 98098 | 98113 | CGCAGATAGAAAAACT | 26 | N/A | N/A | 2235 |
| 950136 | 98099 | 98114 | TCGCAGATAGAAAAAC | 60 | N/A | N/A | 2236 |
| 950137 | 98150 | 98165 | GCACACTGTGGCCAAG | 70 | N/A | N/A | 2237 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 950138 | 98259 | 98274 | AGTGAACGAGTCCCTC | 84 | N/A | N/A | 2238 |
| 950139 | 98353 | 98368 | TTCTACATAGGACCAT | 13 | N/A | N/A | 2239 |
| 950140 | 98399 | 98414 | AAACATCACAGGGACC | 43 | N/A | N/A | 2240 |
| 950141 | 98508 | 98523 | TCAGAAGAGAGGACCT | 42 | N/A | N/A | 2241 |
| 950142 | 98643 | 98658 | AGACACAGGGTAATGC | 35 | N/A | N/A | 2242 |
| 950143 | 98866 | 98881 | CAACAATGCAACAACG | 15 | N/A | N/A | 2243 |
| 950144 | 99310 | 99325 | CGCCAGATTAATTTTG | 46 | N/A | N/A | 2244 |
| 950145 | 99477 | 99492 | AACAATTGTCTGGTGT | 85 | N/A | N/A | 2245 |
| 950146 | 99478 | 99493 | CAACAATTGTCTGGTG | 63 | N/A | N/A | 2246 |
| 950147 | 99481 | 99496 | TAACAACAATTGTCTG | 20 | N/A | N/A | 2247 |
| 950148 | 99493 | 99508 | TAAGACTATAGTTAAC | 63 | N/A | N/A | 2248 |
| 950149 | 99519 | 99534 | CAACAGAAGAGTAGGG | 26 | N/A | N/A | 2249 |
| 950150 | 99522 | 99537 | GTTCAACAGAAGAGTA | 25 | N/A | N/A | 2250 |
| 950151 | 99626 | 99641 | GATAAATACTAGAGGC | 45 | N/A | N/A | 2251 |
| 950152 | 99810 | 99825 | GATCAGGGCCATAGAA | 79 | N/A | N/A | 2252 |
| 950153 | 99823 | 99838 | CAAGAAACGGGTTGAT | 71 | N/A | N/A | 2253 |
| 950154 | 99830 | 99845 | AATTAAGCAAGAAACG | 114 | N/A | N/A | 2254 |
| 950155 | 99893 | 99908 | CAACAAGCTATCACAC | 92 | N/A | N/A | 2255 |
| 950156 | 99912 | 99927 | CTGGACCGCATCAGAG | 92 | N/A | N/A | 2256 |
| 950157 | 99924 | 99939 | TTGAAAGCCAACCTGG | 105 | N/A | N/A | 2257 |
| 950158 | 100015 | 100030 | TAACACAGCCATGGCT | 123 | N/A | N/A | 2258 |
| 950159 | 100020 | 100035 | CCACATAACACAGCCA | 28 | N/A | N/A | 2259 |
| 950160 | 100125 | 100140 | TTGCAGCACAGGGTCA | 56 | N/A | N/A | 2260 |
| 950161 | 100161 | 100176 | GGCAACAGGAGACGCG | 62 | N/A | N/A | 2261 |
| 950162 | 100227 | 100242 | AGAGGCTACATGGTGA | 60 | N/A | N/A | 2262 |
| 950163 | 100328 | 100343 | GAAACAACCAATATCC | 58 | N/A | N/A | 2263 |
| 950164 | 100399 | 100414 | CACGAAGGGTTGACAC | 101 | N/A | N/A | 2264 |
| 950165 | 100435 | 100450 | GGCCAGAGTCCTGACT | 98 | N/A | N/A | 2265 |
| 950166 | 100535 | 100550 | GTTACCAGGACAAAAC | 126 | N/A | N/A | 2266 |
| 950167 | 100670 | 100685 | TGCCATCCCAGGGACC | 105 | N/A | N/A | 2267 |
| 950168 | 100782 | 100797 | CTACAGAGCATTCCCC | 89 | N/A | N/A | 2268 |
| 950169 | 100811 | 100826 | TGCCAGCAAGTCCCCA | 80 | N/A | N/A | 2269 |
| 950170 | 100929 | 100944 | GCCAAGAGGCCCGCCT | 171 | N/A | N/A | 2270 |
| 950171 | 101038 | 101053 | ACCCGAATAGCAAGCG | 54 | N/A | N/A | 2271 |
| 950172 | 101155 | 101170 | GAGCATGGGCCCGCAG | 139 | N/A | N/A | 2272 |
| 950173 | 101255 | 101270 | GATGATCCTTTCACCC | 90 | N/A | N/A | 2273 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 950174 | 101362 | 101377 | CACCACCCTGGGTTTA | 132 | N/A | N/A | 2274 |
| 950175 | 101483 | 101498 | GCAGACCACGCCTGGC | 44 | N/A | N/A | 2275 |
| 950176 | 101603 | 101618 | TGCAAGGCGGAAAGAG | 95 | N/A | N/A | 2276 |
| 950177 | 101718 | 101733 | GGCATTCCCACCCAGG | 84 | N/A | N/A | 2277 |
| 950178 | 101808 | 101823 | GAAAACTAGACTTGCA | 31 | N/A | N/A | 2278 |
| 950179 | 101810 | 101825 | CTGAAAACTAGACTTG | 44 | N/A | N/A | 2279 |
| 950180 | 101850 | 101865 | GAAAAACACGAAGGGC | 86 | N/A | N/A | 2280 |
| 950181 | 101951 | 101966 | TCATTACGGCCGGCGC | 109 | N/A | N/A | 2281 |
| 950182 | 102059 | 102074 | CTAACTTGGGTGGTGG | 43 | N/A | N/A | 2282 |
| 950183 | 102159 | 102174 | AGATATTGATGTCTTG | 7 | N/A | N/A | 2283 |
| 950184 | 102264 | 102279 | GCAGAGGGAGCCCCGA | 90 | N/A | N/A | 2284 |
| 950185 | 102314 | 102329 | TCGCATAGAAGATTCG | 38 | N/A | N/A | 2285 |
| 950186 | 102365 | 102380 | CGGCAGGTGAGTGTCA | 30 | N/A | N/A | 2286 |
| 950187 | 102465 | 102480 | GACTACCTGTTCAGGA | 112 | N/A | N/A | 2287 |
| 950188 | 102585 | 102600 | GAAGAGTGGTGGTTTC | 80 | N/A | N/A | 2288 |
| 950189 | 102639 | 102654 | TGCGAGCCGGCCCCAG | 61 | N/A | N/A | 2289 |
| 950190 | 102716 | 102731 | CACGATCCCAAACCCT | 79 | N/A | N/A | 2290 |
| 950191 | 102830 | 102845 | TGCCGGCACGCACGCG | 135 | N/A | N/A | 2291 |
| 950192 | 102935 | 102950 | CAGCAGGGCCAAGTAA | 61 | N/A | N/A | 2292 |
| 950193 | 103102 | 103117 | GGTAACACAGGGCCTG | 119 | N/A | N/A | 2293 |
| 950207 | 103286 | 103301 | GAGCATAGGAAGAGGG | 27 | N/A | N/A | 2294 |
| 950208 | 103302 | 103317 | GCAAAGAAGTAGGGCA | 81 | N/A | N/A | 2295 |
| 950209 | 103323 | 103338 | GATTAGCCTGCCAGGC | 20 | N/A | N/A | 2296 |
| 950210 | 103425 | 103440 | CCTCATCTATCCAAGG | 99 | N/A | N/A | 2297 |
| 950211 | 103552 | 103567 | GGCACATGGGCTCAGC | 119 | N/A | N/A | 2298 |
| 950212 | 103672 | 103687 | CTCCAAGTTCAGGAGC | 119 | N/A | N/A | 2299 |
| 950213 | 103832 | 103847 | CGCAAGCCACAGCAGG | 101 | N/A | N/A | 2300 |
| 950214 | 103971 | 103986 | ACTCACCCAGTGATGT | 111 | N/A | N/A | 2301 |
| 950215 | 104100 | 104115 | GTTCAGGAAGCACCAA | 20 | N/A | N/A | 2302 |
| 950216 | 104276 | 104291 | AGCCTTACTCCCTTTC | 34 | N/A | N/A | 2303 |
| 950217 | 104326 | 104341 | CGCTTTAGGACATCTT | 63 | N/A | N/A | 2304 |
| 950218 | 104410 | 104425 | TAGGAGTGAGTTACCT | 102 | N/A | N/A | 2305 |
| 950219 | 104458 | 104473 | CACGAAGTGAATGGAA | 13 | N/A | N/A | 2306 |
| 950220 | 104486 | 104501 | ACGCACAACACAACTG | 63 | N/A | N/A | 2307 |
| 950221 | 104560 | 104575 | TGCCACTGGACTGACT | 69 | N/A | N/A | 2308 |
| 950222 | 104606 | 104621 | GACCTAGGTGCCTGAC | 27 | N/A | N/A | 2309 |
| 950223 | 104678 | 104693 | ACTCTACCCGCACCCT | 96 | N/A | N/A | 2310 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 950224 | 104783 | 104798 | CTCCATGATGCTCCCT | 63 | N/A | N/A | 2311 |
| 950225 | 104895 | 104910 | GTGTAGCATGCGCCAC | 124 | N/A | N/A | 2312 |
| 950226 | 104953 | 104968 | GGGAAAAGAGTCACCC | 113 | N/A | N/A | 2313 |
| 950227 | 105113 | 105128 | CTTCACCCCGAGCCAT | 90 | N/A | N/A | 2314 |
| 950228 | 105248 | 105263 | CGGGAAGCATCCCTGG | 114 | N/A | N/A | 2315 |
| 950229 | 105253 | 105268 | CAGCACGGGAAGCATC | 53 | N/A | N/A | 2316 |
| 950230 | 105366 | 105381 | TGCAAGCACCTGAGCC | 99 | N/A | N/A | 2317 |
| 950231 | 105479 | 105494 | CCCTATGGGTTCTGGC | 78 | N/A | N/A | 2318 |
| 950232 | 105561 | 105576 | TCACAATTGGTGCCTT | 16 | N/A | N/A | 2319 |
| 950233 | 105622 | 105637 | CCCCACCTCGGCCAAT | 59 | N/A | N/A | 2320 |
| 950234 | 105668 | 105683 | CTAAATGGAGCTCTTG | 64 | N/A | N/A | 2321 |
| 950235 | 105671 | 105686 | GGCCTAAATGGAGCTC | 79 | N/A | N/A | 2322 |
| 950236 | 105727 | 105742 | CATCACACTCCTCGAT | 96 | N/A | N/A | 2323 |
| 950237 | 105864 | 105879 | ATGTACTGTGAGCTTC | 12 | N/A | N/A | 2324 |
| 950238 | 106002 | 106017 | GCTAATCCCTGACTCA | 37 | N/A | N/A | 2325 |
| 950239 | 106118 | 106133 | ACTCAGCTGGAGTTGG | 63 | N/A | N/A | 2326 |
| 950240 | 106174 | 106189 | GACAAATGGGTCTCGA | 124 | N/A | N/A | 2327 |
| 950241 | 106213 | 106228 | GCCTAGAAGAGCTATG | 97 | N/A | N/A | 2328 |
| 950242 | 106218 | 106233 | GGCAAGCCTAGAAGAG | 95 | N/A | N/A | 2329 |
| 950243 | 106269 | 106284 | AGGCACACGGCTCAGG | 55 | N/A | N/A | 2330 |
| 950244 | 106276 | 106291 | GTACAGGAGGCACACG | 82 | N/A | N/A | 2331 |
| 950245 | 106340 | 106355 | TACTACTCTGGGTTTC | 53 | N/A | N/A | 2332 |
| 950246 | 106457 | 106472 | GAACATGCAGGGCCTG | 13 | N/A | N/A | 2333 |
| 950247 | 106838 | 106853 | AAGAAGTAGAAGTCGG | 36 | N/A | N/A | 2334 |
| 950248 | 106946 | 106961 | GGATGAGGTTGTGTGG | 82 | N/A | N/A | 2335 |
| 950249 | 107060 | 107075 | ACGCACATTTTCCTGT | 59 | N/A | N/A | 2336 |
| 950250 | 107115 | 107130 | TGCTAAACAGTGCTTG | 76 | N/A | N/A | 2337 |
| 950251 | 107478 | 107493 | AAAGTTTAGGCATGGT | 22 | N/A | N/A | 2338 |
| 950252 | 107673 | 107688 | CGTCAATACTAAAATA | 119 | N/A | N/A | 2339 |
| 950253 | 108115 | 108130 | GCCCGAATGTGTTTTG | 72 | N/A | N/A | 2340 |
| 950254 | 108434 | 108449 | CACCAGAACTTTATTA | 92 | N/A | N/A | 2341 |
| 950255 | 108584 | 108599 | GGCAAGTGTCTGAGTT | 17 | N/A | N/A | 2342 |
| 950256 | 108685 | 108700 | TCTGACTGATCAGGAA | 85 | N/A | N/A | 2343 |
| 950257 | 108748 | 108763 | GCACAAGCTTGACCCT | 92 | N/A | N/A | 2344 |
| 950258 | 108970 | 108985 | GAAAATGACCTGTCCT | 92 | N/A | N/A | 2345 |
| 950259 | 109080 | 109095 | CCGTGAGGGAACTTTC | 69 | N/A | N/A | 2346 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 950260 | 109124 | 109139 | AAGCAAGTGGGACCCC | 79 | N/A | N/A | 2347 |
| 950261 | 109129 | 109144 | GAACAAAGCAAGTGGG | 62 | N/A | N/A | 2348 |
| 950262 | 109183 | 109198 | GGCCAAGGGTGGCCAT | 143 | N/A | N/A | 2349 |
| 950263 | 109205 | 109220 | CGGCAAGGCATTTTAA | 88 | N/A | N/A | 2350 |
| 950264 | 109407 | 109422 | TTTAAGCGATCTCCTG | 31 | N/A | N/A | 2351 |
| 950265 | 109408 | 109423 | GTTTAAGCGATCTCCT | 39 | N/A | N/A | 2352 |
| 950266 | 109516 | 109531 | ACCCAACCTTGGGACA | 75 | N/A | N/A | 2353 |
| 950267 | 109576 | 109591 | CCCAAAGGATCTGCCC | 101 | N/A | N/A | 2354 |
| 950268 | 109649 | 109664 | TGCCTGGGTATGTTTG | 76 | N/A | N/A | 2355 |
| 950269 | 109910 | 109925 | AGATAGGCCTGCTTGC | 70 | N/A | N/A | 2356 |
| 950270 | 109914 | 109929 | CACCAGATAGGCCTGC | 74 | N/A | N/A | 2357 |
| 950271 | 110212 | 110227 | ACTCACATTGTTGATC | 92 | N/A | N/A | 2358 |
| 950272 | 110607 | 110622 | CTCTAGGCTTACCACA | 53 | N/A | N/A | 2359 |
| 950273 | 110885 | 110900 | GCCTAGGGTGCCTGGC | 105 | N/A | N/A | 2360 |
| 950274 | 110899 | 110914 | TACAAACAGGTATGGC | 20 | N/A | N/A | 2361 |
| 950275 | 110900 | 110915 | CTACAAACAGGTATGG | 46 | N/A | N/A | 2362 |
| 950276 | 111043 | 111058 | TCAAATTTGTTGTTGC | 14 | N/A | N/A | 2363 |
| 950277 | 111093 | 111108 | CCAAAGAGGATGGCCG | 66 | N/A | N/A | 2364 |
| 950278 | 111150 | 111165 | AGTTAGTGGACTTGAT | 37 | N/A | N/A | 2365 |
| 950279 | 111166 | 111181 | CTGCAGTGTTCACTCC | 64 | N/A | N/A | 2366 |
| 950280 | 111195 | 111210 | GCCTAAGTTAATTCAG | 88 | N/A | N/A | 2367 |
| 950281 | 111339 | 111354 | GCAACCAGGGTAAACG | 94 | N/A | N/A | 2368 |
| 950282 | 111471 | 111486 | ACTGAAGAGGAGCCCA | 57 | N/A | N/A | 2369 |
| 950283 | 111548 | 111563 | GCCAAAGGCCTGATAC | 96 | N/A | N/A | 2370 |
| 950284 | 111581 | 111596 | GGTTTATAAAGCTTCC | 35 | N/A | N/A | 2371 |
| 950285 | 111781 | 111796 | TCTTACCTCGGTCTTC | 66 | N/A | N/A | 2372 |
| 950286 | 111872 | 111887 | TGAAAGAGGTTCCTGC | 36 | N/A | N/A | 2373 |
| 950287 | 111910 | 111925 | GTTGACATTCATATAC | 68 | N/A | N/A | 2374 |
| 950288 | 112131 | 112146 | TGAGAATGGGAGCAAC | 39 | N/A | N/A | 2375 |
| 950289 | 112147 | 112162 | GAACACTGATCACTAC | 32 | N/A | N/A | 2376 |
| 950290 | 112174 | 112189 | AAACATACCAGGACAC | 39 | N/A | N/A | 2377 |
| 950291 | 112192 | 112207 | TCCTATCGGTATATGA | 139 | N/A | N/A | 2378 |
| 950292 | 112222 | 112237 | TCATAGCAGAAGAACC | 28 | N/A | N/A | 2379 |
| 950293 | 112260 | 112275 | TAAACTTGCAGGGTCA | 9 | N/A | N/A | 2380 |
| 950294 | 112267 | 112282 | CTAAAAGTAAACTTGC | 98 | N/A | N/A | 2381 |
| 950295 | 112360 | 112375 | TCCCATCTTTGGCTGC | 37 | N/A | N/A | 2382 |
| 950296 | 112902 | 112917 | TCCTACTGGATACAGA | 58 | N/A | N/A | 2383 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 950299 | 113293 | 113308 | GCCAATCCTGTTATAT | 97 | N/A | N/A | 2384 |
| 950300 | 113614 | 113629 | GCAGAATAATCCTGTT | 77 | N/A | N/A | 2385 |
| 950301 | 113616 | 113631 | TGGCAGAATAATCCTG | 69 | N/A | N/A | 2386 |
| 950302 | 113780 | 113795 | GTTGACACCATGCTTG | 14 | N/A | N/A | 2387 |
| 950303 | 113923 | 113938 | CCCCAGACTTTTTTGA | 101 | N/A | N/A | 2388 |
| 950304 | 114269 | 114284 | AACCAGGCTTCCGGAC | 83 | N/A | N/A | 2389 |
| 950305 | 114450 | 114465 | AGCTGTAGGGCTGGCT | 61 | N/A | N/A | 2390 |
| 950306 | 114637 | 114652 | TCTGGCCACGCCTTGC | 93 | N/A | N/A | 2391 |
| 950307 | 114737 | 114752 | CCTTAAGGAACTCCAT | 109 | N/A | N/A | 2392 |
| 950308 | 114843 | 114858 | CCTAATATCTCTAGGG | 82 | N/A | N/A | 2393 |
| 950309 | 115000 | 115015 | GCGCAGTGGGATCCTC | 178 | N/A | N/A | 2394 |
| 950310 | 115042 | 115057 | TGCCAGAACCTGAGGT | 96 | N/A | N/A | 2395 |
| 950311 | 115081 | 115096 | ATACAGATGGAGTAGG | 63 | N/A | N/A | 2396 |
| 950312 | 115423 | 115438 | ACAGGAGGAGAGACCC | 58 | N/A | N/A | 2397 |
| 950313 | 115497 | 115512 | CCAAATAGGGATGAGG | 87 | N/A | N/A | 2398 |
| 950314 | 115504 | 115519 | TCGCAAGCCAAATAGG | 29 | N/A | N/A | 2399 |
| 950315 | 115538 | 115553 | GAACAAGCCTCTTGGC | 142 | N/A | N/A | 2400 |
| 950316 | 115640 | 115655 | GCCCAGTGTGAGGGTT | 102 | N/A | N/A | 2401 |
| 950317 | 115795 | 115810 | CATCAACTCGCCTGCT | 101 | N/A | N/A | 2402 |
| 950318 | 115915 | 115930 | CCGGGAGCAAGAGGCA | 160 | N/A | N/A | 2403 |
| 951323 | 3692 | 3707 | CCAGATGGCAGACTTC | 19 | N/A | N/A | 2404 |
| 951324 | 3772 | 3787 | AGATATCTAGATGGCC | 111 | N/A | N/A | 2405 |
| 951325 | 3773 | 3788 | TAGATATCTAGATGGC | 63 | N/A | N/A | 2406 |
| 951326 | 3774 | 3789 | ATAGATATCTAGATGG | 52 | N/A | N/A | 2407 |
| 951327 | 3884 | 3899 | CCAAATGGTGGTGGCA | 84 | N/A | N/A | 2408 |
| 951328 | 4373 | 4388 | CCAATTTGTAGGCTGT | 9 | N/A | N/A | 2409 |
| 951329 | 4487 | 4502 | ACAGATGGGCACACCG | 91 | N/A | N/A | 2410 |
| 951330 | 4647 | 4662 | ACAAATGAGTAGTTCC | 6 | N/A | N/A | 2411 |
| 951331 | 4668 | 4683 | TCATTTGGCAGCCACA | 41 | N/A | N/A | 2412 |
| 951332 | 4670 | 4685 | TATCATTTGGCAGCCA | 77 | N/A | N/A | 2413 |
| 951333 | 4673 | 4688 | TGTTATCATTTGGCAG | 13 | N/A | N/A | 2414 |
| 951334 | 4767 | 4782 | CCTTACTTGGGATTCA | 64 | N/A | N/A | 2415 |
| 951335 | 4792 | 4807 | ATGATAACACAGCCTC | 47 | N/A | N/A | 2416 |
| 951336 | 4793 | 4808 | GATGATAACACAGCCT | 46 | N/A | N/A | 2417 |
| 951337 | 4795 | 4810 | GGGATGATAACACAGC | 104 | N/A | N/A | 2418 |
| 951338 | 4917 | 4932 | GAGATTTGTGCTGCTT | 16 | N/A | N/A | 2419 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951339 | 5744 | 5759 | GTAAGTAAGCACTTTT | 45 | N/A | N/A | 2420 |
| 951340 | 5899 | 5914 | GGATTATAGCAATGCC | 12 | N/A | N/A | 2421 |
| 951341 | 5970 | 5985 | TCACTTTACAGCCTCC | 9 | N/A | N/A | 2422 |
| 951342 | 6124 | 6139 | GGATTCTAGGAGGTCG | 36 | N/A | N/A | 2423 |
| 951343 | 6458 | 6473 | ATTAATACTCTTAACG | 57 | N/A | N/A | 2424 |
| 951344 | 6738 | 6753 | ACTAACTGGGCTGTTC | 53 | N/A | N/A | 2425 |
| 951345 | 6740 | 6755 | GAACTAACTGGGCTGT | 40 | N/A | N/A | 2426 |
| 951346 | 6857 | 6872 | GGAAATCTAACACTGG | 7 | N/A | N/A | 2427 |
| 951347 | 6908 | 6923 | AACTCTATAGATCTGA | 101 | N/A | N/A | 2428 |
| 951348 | 6959 | 6974 | AGACATGGTGGAACCA | 81 | N/A | N/A | 2429 |
| 951349 | 7117 | 7132 | GATTACAACAACAGCC | 76 | N/A | N/A | 2430 |
| 951350 | 7175 | 7190 | TGAAATCGAAGCCATT | 95 | N/A | N/A | 2431 |
| 951351 | 7399 | 7414 | TAAATGACAAGGGTCA | 83 | N/A | N/A | 2432 |
| 951352 | 7942 | 7957 | GCTATTATAACTTGTA | 8 | N/A | N/A | 2433 |
| 951353 | 8568 | 8583 | ATTTTAAAGAAGACGG | 42 | N/A | N/A | 2434 |
| 951354 | 8583 | 8598 | GCTATTATAACTCCTA | 11 | N/A | N/A | 2435 |
| 951355 | 8616 | 8631 | CACTTAATCCCTATTC | 74 | N/A | N/A | 2436 |
| 951356 | 9095 | 9110 | ATACTTATCGCCTTTT | 5 | N/A | N/A | 2437 |
| 951357 | 9099 | 9114 | CATCATACTTATCGCC | 6 | N/A | N/A | 2438 |
| 951358 | 9144 | 9159 | TCCAACTGTGATCTCT | 8 | N/A | N/A | 2439 |
| 951359 | 10032 | 10047 | CCAAGGAACACATCAC | 25 | N/A | N/A | 2440 |
| 951360 | 10064 | 10079 | ACTAATAAGATCTGTT | 97 | N/A | N/A | 2441 |
| 951361 | 10131 | 10146 | TGCAATTTGTCTTTGC | 78 | N/A | N/A | 2442 |
| 951362 | 10136 | 10151 | CAAGATGCAATTTGTC | 3 | N/A | N/A | 2443 |
| 951363 | 10700 | 10715 | CGAGATCACAAATGCT | 41 | N/A | N/A | 2444 |
| 951364 | 11386 | 11401 | AGTAATGATGAGTTCC | 3 | N/A | N/A | 2445 |
| 951365 | 11416 | 11431 | CACTGATAGGCACTCC | 8 | N/A | N/A | 2446 |
| 951366 | 11553 | 11568 | ATTACTTGTTTGCAGC | 8 | N/A | N/A | 2447 |
| 951367 | 11556 | 11571 | CCAATTACTTGTTTGC | 8 | N/A | N/A | 2448 |
| 951368 | 11572 | 11587 | TAAATAACTCTCACGG | 25 | N/A | N/A | 2449 |
| 951369 | 11573 | 11588 | GTAAATAACTCTCACG | 86 | N/A | N/A | 2450 |
| 951370 | 11575 | 11590 | GTGTAAATAACTCTCA | 10 | N/A | N/A | 2451 |
| 951371 | 11922 | 11937 | GTTGATAGTCGGTTGT | 4 | N/A | N/A | 2452 |
| 951372 | 11960 | 11975 | GGTCATTAAAGATTCT | 4 | N/A | N/A | 2453 |
| 951373 | 11990 | 12005 | GGTACCTAACAGGTCT | 93 | N/A | N/A | 2454 |
| 951374 | 12062 | 12077 | GTCTTTCCGGTCTTTT | 4 | N/A | N/A | 2455 |
| 951375 | 12148 | 12163 | GATTATAAACCTAATC | 121 | N/A | N/A | 2456 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951376 | 12215 | 12230 | TCAATAAGTAACTCTG | 11 | N/A | N/A | 2457 |
| 951377 | 12216 | 12231 | GTCAATAAGTAACTCT | 140 | N/A | N/A | 2458 |
| 951378 | 12237 | 12252 | ACCTATCAAGGGCTGT | 27 | N/A | N/A | 2459 |
| 951379 | 12244 | 12259 | GTTATGAACCTATCAA | 20 | N/A | N/A | 2460 |
| 951380 | 12245 | 12260 | TGTTATGAACCTATCA | 47 | N/A | N/A | 2461 |
| 951381 | 12850 | 12865 | GTTTACATGATGTTCT | 7 | N/A | N/A | 2462 |
| 951382 | 12860 | 12875 | GTAAATTACGGTTTAC | 122 | N/A | N/A | 2463 |
| 951383 | 12861 | 12876 | AGTAAATTACGGTTTA | 14 | N/A | N/A | 2464 |
| 951384 | 12890 | 12905 | CTTAATTACAGCTTGT | 6 | N/A | N/A | 2465 |
| 951385 | 12934 | 12949 | TCATTATTGGCTTGGA | 41 | N/A | N/A | 2466 |
| 951386 | 12935 | 12950 | CTCATTATTGGCTTGG | 4 | N/A | N/A | 2467 |
| 951387 | 12971 | 12986 | CCTTTATTCAGATTGT | 3 | N/A | N/A | 2468 |
| 951388 | 13136 | 13151 | AGTCATCCAGCTCCCG | 54 | N/A | N/A | 2469 |
| 951389 | 13167 | 13182 | ATAAATGTCCAGCAGC | 44 | N/A | N/A | 2470 |
| 951390 | 13169 | 13184 | TCATAAATGTCCAGCA | 63 | N/A | N/A | 2471 |
| 951391 | 13170 | 13185 | ATCATAAATGTCCAGC | 32 | N/A | N/A | 2472 |
| 951392 | 13392 | 13407 | GCCATATGTGTGGCTC | 65 | N/A | N/A | 2473 |
| 951393 | 13487 | 13502 | TGTAATCTTGGCCCAG | 83 | N/A | N/A | 2474 |
| 951394 | 13521 | 13536 | TGCATATCCAAAGCCA | 83 | N/A | N/A | 2475 |
| 951395 | 14442 | 14457 | CCACATGTGAAGCAGC | 21 | N/A | N/A | 2476 |
| 951396 | 14476 | 14491 | GGCTATTCCACTGCAG | 99 | N/A | N/A | 2477 |
| 951397 | 14694 | 14709 | TCTGTAATGGTTTCCC | 5 | N/A | N/A | 2478 |
| 951398 | 14808 | 14823 | TGTACCTAAGTACAGA | 97 | N/A | N/A | 2479 |
| 951399 | 14824 | 14839 | TCTATAGGTACCAGCA | 50 | N/A | N/A | 2480 |
| 951400 | 15508 | 15523 | AGTGAAATTCACTCCA | 47 | N/A | N/A | 2481 |
| 951401 | 15651 | 15666 | CTCTTTATATAGATGG | 58 | N/A | N/A | 2482 |
| 951402 | 16748 | 16763 | AGAGATACATCAACCC | 35 | N/A | N/A | 2483 |
| 951403 | 17836 | 17851 | AAATATAGCAGGGACC | 51 | N/A | N/A | 2484 |
| 951404 | 17839 | 17854 | ACTAAATATAGCAGGG | 30 | N/A | N/A | 2485 |
| 951405 | 17842 | 17857 | GGCACTAAATATAGCA | 71 | N/A | N/A | 2486 |
| 951406 | 19042 | 19057 | TAGTATACCAAGGTTA | 11 | N/A | N/A | 2487 |
| 951407 | 19043 | 19058 | GTAGTATACCAAGGTT | 6 | N/A | N/A | 2488 |
| 951408 | 19760 | 19775 | CAGTATGTATACTTCC | 2 | N/A | N/A | 2489 |
| 951409 | 19761 | 19776 | TCAGTATGTATACTTC | 86 | N/A | N/A | 2490 |
| 951410 | 20345 | 20360 | TCCTGATAAGATTCAC | 17 | N/A | N/A | 2491 |
| 951411 | 20392 | 20407 | TCAGTTATCACTGTCA | 31 | N/A | N/A | 2492 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951412 | 20458 | 20473 | ACTAGTAACTTTCCAG | 37 | N/A | N/A | 2493 |
| 951413 | 20741 | 20756 | GGATTATTACATGAGT | 11 | N/A | N/A | 2494 |
| 951414 | 20743 | 20758 | GAGGATTATTACATGA | 29 | N/A | N/A | 2495 |
| 951415 | 20864 | 20879 | GCCAACTAATTCCAGA | 46 | N/A | N/A | 2496 |
| 951416 | 21512 | 21527 | ATATATGTGGAGGCAA | 10 | N/A | N/A | 2497 |
| 951417 | 21513 | 21528 | TATATATGTGGAGGCA | 104 | N/A | N/A | 2498 |
| 951418 | 21515 | 21530 | AATATATATGTGGAGG | 4 | N/A | N/A | 2499 |
| 951419 | 21654 | 21669 | CACTATTGGCACACCA | 115 | N/A | N/A | 2500 |
| 951420 | 21655 | 21670 | ACACTATTGGCACACC | 122 | N/A | N/A | 2501 |
| 951421 | 21656 | 21671 | AACACTATTGGCACAC | 111 | N/A | N/A | 2502 |
| 951422 | 21840 | 21855 | TTCTTAACAGGCTCCC | 41 | N/A | N/A | 2503 |
| 951423 | 22010 | 22025 | TAAGTATGCGCTGCCA | 31 | N/A | N/A | 2504 |
| 951424 | 22134 | 22149 | AGGATATAGGGTCTCC | 97 | N/A | N/A | 2505 |
| 951425 | 22135 | 22150 | AAGGATATAGGGTCTC | 37 | N/A | N/A | 2506 |
| 951426 | 22212 | 22227 | GAACATCATGGAGCCT | 33 | N/A | N/A | 2507 |
| 951427 | 23308 | 23323 | TTTGATACTGATCTCA | 18 | N/A | N/A | 2508 |
| 951428 | 24284 | 24299 | GGTATTATGGTATGTG | 2 | N/A | N/A | 2509 |
| 951429 | 24285 | 24300 | AGGTATTATGGTATGT | 2 | N/A | N/A | 2510 |
| 951430 | 24396 | 24411 | TCATATGTATGGGTTT | 4 | N/A | N/A | 2511 |
| 951431 | 24398 | 24413 | CTTCATATGTATGGGT | 10 | N/A | N/A | 2512 |
| 951432 | 25701 | 25716 | ATAGATGTAAGCAACT | 51 | N/A | N/A | 2513 |
| 951433 | 25709 | 25724 | GGAAATTCATAGATGT | 113 | N/A | N/A | 2514 |
| 951434 | 25740 | 25755 | ACTTATGGATGCAGCT | 52 | N/A | N/A | 2515 |
| 951435 | 25741 | 25756 | AACTTATGGATGCAGC | 39 | N/A | N/A | 2516 |
| 951436 | 26160 | 26175 | AGCATTGGTATCAGGC | 35 | N/A | N/A | 2517 |
| 951437 | 26168 | 26183 | TGGATATCAGCATTGG | 17 | N/A | N/A | 2518 |
| 951438 | 26173 | 26188 | ATGGATGGATATCAGC | 41 | N/A | N/A | 2519 |
| 951439 | 26180 | 26195 | TTCAATCATGGATGGA | 72 | N/A | N/A | 2520 |
| 951440 | 27070 | 27085 | GGAATACTTGCAGCTA | 41 | N/A | N/A | 2521 |
| 951441 | 27071 | 27086 | AGGAATACTTGCAGCT | 11 | N/A | N/A | 2522 |
| 951442 | 27224 | 27239 | CAACATGGCACTCCCT | 64 | N/A | N/A | 2523 |
| 951443 | 27231 | 27246 | TCTGATGCAACATGGC | 12 | N/A | N/A | 2524 |
| 951444 | 27569 | 27584 | ATCATTGGGTGAAGAC | 43 | N/A | N/A | 2525 |
| 951445 | 27762 | 27777 | GGTCTATTGGCACACA | 32 | N/A | N/A | 2526 |
| 951446 | 27776 | 27791 | AGATTAAGTCATCCGG | 90 | N/A | N/A | 2527 |
| 951447 | 27777 | 27792 | GAGATTAAGTCATCCG | 61 | N/A | N/A | 2528 |
| 951448 | 27778 | 27793 | AGAGATTAAGTCATCC | 73 | N/A | N/A | 2529 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951449 | 28228 | 28243 | GCAAATGCTAGCTGCA | 142 | N/A | N/A | 2530 |
| 951450 | 29274 | 29289 | CGCTCTAATGTCCTGA | 11 | N/A | N/A | 2531 |
| 951451 | 29308 | 29323 | TGGATATCCAGACCCA | 97 | N/A | N/A | 2532 |
| 951452 | 29321 | 29336 | GCAGATCCTGCCTTGG | 92 | N/A | N/A | 2533 |
| 951453 | 29584 | 29599 | TGAACTAGAGGCAGGC | 29 | N/A | N/A | 2534 |
| 951454 | 29585 | 29600 | GTGAACTAGAGGCAGG | 19 | N/A | N/A | 2535 |
| 951455 | 29974 | 29989 | TGTAACTTTCAGCAGT | 25 | N/A | N/A | 2536 |
| 951456 | 29999 | 30014 | TGTGATTGCAGGCCAG | 13 | N/A | N/A | 2537 |
| 951457 | 30053 | 30068 | TTTTATAGTCTCCAAC | 140 | N/A | N/A | 2538 |
| 951458 | 30107 | 30122 | TGTATGGACAGCAGGC | 13 | N/A | N/A | 2539 |
| 951459 | 30108 | 30123 | GTGTATGGACAGCAGG | 10 | N/A | N/A | 2540 |
| 951460 | 30242 | 30257 | ATCAATCTTGGGAGCT | 39 | N/A | N/A | 2541 |
| 951461 | 30246 | 30261 | CTAAATCAATCTTGGG | 40 | N/A | N/A | 2542 |
| 951462 | 30348 | 30363 | ATATTAATGCAGTGGT | 4 | N/A | N/A | 2543 |
| 951463 | 30349 | 30364 | CATATTAATGCAGTGG | 14 | N/A | N/A | 2544 |
| 951464 | 30350 | 30365 | ACATATTAATGCAGTG | 66 | N/A | N/A | 2545 |
| 951465 | 30407 | 30422 | AGAATATCAACACCTT | 69 | N/A | N/A | 2546 |
| 951466 | 30408 | 30423 | TAGAATATCAACACCT | 61 | N/A | N/A | 2547 |
| 951467 | 30426 | 30441 | TTATCTAACAGTCCCA | 45 | N/A | N/A | 2548 |
| 951468 | 30429 | 30444 | CATTTATCTAACAGTC | 104 | N/A | N/A | 2549 |
| 951469 | 30509 | 30524 | TAGTGATATGCTGCCT | 22 | N/A | N/A | 2550 |
| 951470 | 30852 | 30867 | CACAATCCTGGCTATC | 56 | N/A | N/A | 2551 |
| 951471 | 30931 | 30946 | CCAGACATTGCTGTCG | 108 | N/A | N/A | 2552 |
| 951472 | 31367 | 31382 | ACATTTGACGGTTTGA | 15 | N/A | N/A | 2553 |
| 951473 | 32256 | 32271 | GGGAATGATGCCACCT | 110 | N/A | N/A | 2554 |
| 951474 | 32270 | 32285 | CCAATCTGTTATGTGG | 23 | N/A | N/A | 2555 |
| 951475 | 32336 | 32351 | TGGAATCCAGTATTTC | 103 | N/A | N/A | 2556 |
| 951476 | 32498 | 32513 | AGGAATCCTGCAGCTC | 108 | N/A | N/A | 2557 |
| 951477 | 32722 | 32737 | TCCTATTAGAGTGGCA | 49 | N/A | N/A | 2558 |
| 951478 | 32905 | 32920 | AGCATTAACAGAGCAG | 92 | N/A | N/A | 2559 |
| 951479 | 33017 | 33032 | GGCTTTACTCCAGCCA | 104 | N/A | N/A | 2560 |
| 951480 | 33518 | 33533 | AACAATAGCCATTGGT | 107 | N/A | N/A | 2561 |
| 951481 | 34302 | 34317 | TGTTTATTTACCGTTT | 3 | N/A | N/A | 2562 |
| 951482 | 35180 | 35195 | AGTACTATTGCATCAT | 28 | N/A | N/A | 2563 |
| 951483 | 36041 | 36056 | TCACATACAGACCCCA | 59 | N/A | N/A | 2564 |
| 951484 | 36073 | 36088 | CTAAATGTCACTTAGC | 40 | N/A | N/A | 2565 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951485 | 36087 | 36102 | GGAACTAACACATGCT | 23 | N/A | N/A | 2566 |
| 951486 | 36362 | 36377 | GAAATCTACCTACTCC | 105 | N/A | N/A | 2567 |
| 951487 | 36363 | 36378 | TGAAATCTACCTACTC | 121 | N/A | N/A | 2568 |
| 951488 | 36617 | 36632 | GGCACCAACATTCACC | 96 | N/A | N/A | 2569 |
| 951489 | 36660 | 36675 | TCCGATTTTGCTTCTA | 10 | N/A | N/A | 2570 |
| 951490 | 36665 | 36680 | ACTTATCCGATTTTGC | 23 | N/A | N/A | 2571 |
| 951491 | 36809 | 36824 | TGTTATTCCGAACAGT | 43 | N/A | N/A | 2572 |
| 951492 | 36911 | 36926 | TCTCATGGCGACTGGC | 77 | N/A | N/A | 2573 |
| 951493 | 36948 | 36963 | GGAATAAAGGCTCTCG | 22 | N/A | N/A | 2574 |
| 951494 | 37009 | 37024 | TTAGATTGTATGACCC | 9 | N/A | N/A | 2575 |
| 951495 | 37194 | 37209 | GGCTTTGTTAGATGCC | 107 | N/A | N/A | 2576 |
| 951496 | 37246 | 37261 | ATTCATAGTACCCCAC | 62 | N/A | N/A | 2577 |
| 951497 | 37304 | 37319 | GTATTTGTAGTGTGGA | 110 | N/A | N/A | 2578 |
| 951498 | 37305 | 37320 | GGTATTTGTAGTGTGG | 10 | N/A | N/A | 2579 |
| 951499 | 37446 | 37461 | GACAATGGTGATGCCC | 62 | N/A | N/A | 2580 |
| 951500 | 37566 | 37581 | ATCTTAGGCAGACCCT | 42 | N/A | N/A | 2581 |
| 951501 | 37570 | 37585 | ACACATCTTAGGCAGA | 14 | N/A | N/A | 2582 |
| 951502 | 37729 | 37744 | ATTAAAATGGGTCTGC | 77 | N/A | N/A | 2583 |
| 951503 | 37750 | 37765 | CATTTAACCATGACAG | 31 | N/A | N/A | 2584 |
| 951504 | 37751 | 37766 | CCATTTAACCATGACA | 32 | N/A | N/A | 2585 |
| 951505 | 37971 | 37986 | ACCTTAAGTTTTTTGG | 118 | N/A | N/A | 2586 |
| 951506 | 38196 | 38211 | GCTAATAGCTATTCAA | 39 | N/A | N/A | 2587 |
| 951507 | 38225 | 38240 | CGCATTACTGAGTTCA | 12 | N/A | N/A | 2588 |
| 951508 | 38335 | 38350 | GTGACTAAGACAACCA | 40 | N/A | N/A | 2589 |
| 951509 | 38538 | 38553 | AGACATGTAACTCCCT | 39 | N/A | N/A | 2590 |
| 951510 | 38540 | 38555 | CTAGACATGTAACTCC | 72 | N/A | N/A | 2591 |
| 951511 | 38592 | 38607 | GCCTATCCATGCTGCT | 105 | N/A | N/A | 2592 |
| 951512 | 39123 | 39138 | CAGAATTGTTACAACC | 47 | N/A | N/A | 2593 |
| 951513 | 39140 | 39155 | CCATTAAAATTTGCCC | 30 | N/A | N/A | 2594 |
| 951514 | 39141 | 39156 | TCCATTAAAATTTGCC | 44 | N/A | N/A | 2595 |
| 951515 | 39233 | 39248 | TTAACTATATCTAACT | 73 | N/A | N/A | 2596 |
| 951516 | 39236 | 39251 | CGATTAACTATATCTA | 87 | N/A | N/A | 2597 |
| 951517 | 39547 | 39562 | ATTTATGCGATTGGCC | 88 | N/A | N/A | 2598 |
| 951518 | 39548 | 39563 | GATTTATGCGATTGGC | 17 | N/A | N/A | 2599 |
| 951519 | 39549 | 39564 | AGATTTATGCGATTGG | 11 | N/A | N/A | 2600 |
| 951520 | 39555 | 39570 | TGTTTAAGATTTATGC | 41 | N/A | N/A | 2601 |
| 951521 | 39748 | 39763 | AAAGTAATTCACTGCG | 81 | N/A | N/A | 2602 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951522 | 40198 | 40213 | ATGGACTACAGTCTGT | 110 | N/A | N/A | 2603 |
| 951523 | 40275 | 40290 | TGCAATCACAGACATC | 93 | N/A | N/A | 2604 |
| 951524 | 41080 | 41095 | GTATTAACCTCATGAA | 93 | N/A | N/A | 2605 |
| 951525 | 41081 | 41096 | GGTATTAACCTCATGA | 68 | N/A | N/A | 2606 |
| 951526 | 41125 | 41140 | GTCTTTCCGTCACAGT | 40 | N/A | N/A | 2607 |
| 951527 | 41273 | 41288 | GGATAATTGGAGAGGG | 94 | N/A | N/A | 2608 |
| 951528 | 41274 | 41289 | GGGATAATTGGAGAGG | 68 | N/A | N/A | 2609 |
| 951529 | 42072 | 42087 | GGGATTATGATGAGGA | 3 | N/A | N/A | 2610 |
| 951530 | 42327 | 42342 | GATGATGGGTTCTAGC | 85 | N/A | N/A | 2611 |
| 951531 | 42355 | 42370 | GGGAGATGTGCTCTTT | 49 | N/A | N/A | 2612 |
| 951532 | 42381 | 42396 | GTATTACCCAGTGGCT | 62 | N/A | N/A | 2613 |
| 951533 | 42382 | 42397 | TGTATTACCCAGTGGC | 15 | N/A | N/A | 2614 |
| 951534 | 42387 | 42402 | GGGAATGTATTACCCA | 131 | N/A | N/A | 2615 |
| 951535 | 42501 | 42516 | TACAATCATTCCCAGC | 89 | N/A | N/A | 2616 |
| 951536 | 42506 | 42521 | AGCACTACAATCATTC | 82 | N/A | N/A | 2617 |
| 951537 | 42569 | 42584 | TACTGTACAGCTGTGC | 8 | N/A | N/A | 2618 |
| 951538 | 42578 | 42593 | GGCAATTGGTACTGTA | 121 | N/A | N/A | 2619 |
| 951539 | 42599 | 42614 | GAAAATTTGTACAGGA | 55 | N/A | N/A | 2620 |
| 951540 | 43029 | 43044 | TACATTAAAGGCTCGA | 44 | N/A | N/A | 2621 |
| 951541 | 43843 | 43858 | GTACATATCCTGGCCG | 32 | N/A | N/A | 2622 |
| 951542 | 43871 | 43886 | TACTATTCGACAGAGC | 31 | N/A | N/A | 2623 |
| 951543 | 43873 | 43888 | ATTACTATTCGACAGA | 36 | N/A | N/A | 2624 |
| 951544 | 43876 | 43891 | TAAATTACTATTCGAC | 45 | N/A | N/A | 2625 |
| 951545 | 43877 | 43892 | GTAAATTACTATTCGA | 63 | N/A | N/A | 2626 |
| 951546 | 43878 | 43893 | TGTAAATTACTATTCG | 19 | N/A | N/A | 2627 |
| 951547 | 44416 | 44431 | GAGATCAACACATTTC | 57 | N/A | N/A | 2628 |
| 951548 | 44701 | 44716 | AGAAATTACTCTTGCG | 116 | N/A | N/A | 2629 |
| 951549 | 44902 | 44917 | TCCAATGACAGCCCAG | 26 | N/A | N/A | 2630 |
| 951550 | 44914 | 44929 | GTGAATTCAATGTCCA | 11 | N/A | N/A | 2631 |
| 951551 | 44929 | 44944 | ACACATGTGGAACACG | 80 | N/A | N/A | 2632 |
| 951552 | 45353 | 45368 | TATCTATAACACATGA | 44 | N/A | N/A | 2633 |
| 951553 | 45356 | 45371 | GGTTATCTATAACACA | 23 | N/A | N/A | 2634 |
| 951554 | 45446 | 45461 | GTCTTTATTGCATGGG | 8 | N/A | N/A | 2635 |
| 951555 | 45569 | 45584 | GCTATAAAACCAGCCA | 101 | N/A | N/A | 2636 |
| 951556 | 45590 | 45605 | AGCATTGGATTGAGCA | 89 | N/A | N/A | 2637 |
| 951557 | 46280 | 46295 | AGCAATGGTGGCCGGG | 109 | N/A | N/A | 2638 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951558 | 46328 | 46343 | CTATATTCAACAGGCT | 24 | N/A | N/A | 2639 |
| 951559 | 46329 | 46344 | ACTATATTCAACAGGC | 61 | N/A | N/A | 2640 |
| 951560 | 46335 | 46350 | GGCCATACTATATTCA | 102 | N/A | N/A | 2641 |
| 951561 | 46428 | 46443 | GGGATATACGCCCACC | 8 | N/A | N/A | 2642 |
| 951562 | 46590 | 46605 | TATTTAAAAGGGCCGC | 23 | N/A | N/A | 2643 |
| 951563 | 46591 | 46606 | GTATTTAAAAGGGCCG | 97 | N/A | N/A | 2644 |
| 951564 | 46861 | 46876 | CGAAATAGCAGAGCTC | 75 | N/A | N/A | 2645 |
| 951565 | 46961 | 46976 | TCTATAGTGACTCTCA | 9 | N/A | N/A | 2646 |
| 951566 | 46962 | 46977 | TTCTATAGTGACTCTC | 6 | N/A | N/A | 2647 |
| 951567 | 47624 | 47639 | GTTCATCCGGGTCAGG | 36 | N/A | N/A | 2648 |
| 951568 | 47926 | 47941 | GCAACTATGCATCCAC | 141 | N/A | N/A | 2649 |
| 951569 | 48813 | 48828 | GAACATGGCAGCCAGT | 82 | N/A | N/A | 2650 |
| 951570 | 48973 | 48988 | TGCTTAATGCCTTGCC | 82 | N/A | N/A | 2651 |
| 951571 | 49051 | 49066 | CGCAATGTGTTCATTT | 27 | N/A | N/A | 2652 |
| 951572 | 49192 | 49207 | ACTTTAACAAGTCCCG | 36 | N/A | N/A | 2653 |
| 951573 | 49193 | 49208 | CACTTTAACAAGTCCC | 23 | N/A | N/A | 2654 |
| 951574 | 49227 | 49242 | ACAGATGAAGCTACCA | 27 | N/A | N/A | 2655 |
| 951575 | 49443 | 49458 | GGTTATGGTCTTAGGT | 16 | N/A | N/A | 2656 |
| 951576 | 49674 | 49689 | TCGATTTGATTCTGAG | 84 | N/A | N/A | 2657 |
| 951577 | 50575 | 50590 | GACAAATTGCCACTGG | 54 | N/A | N/A | 2658 |
| 951578 | 50595 | 50610 | GCAAATATCTCCCAGT | 19 | N/A | N/A | 2659 |
| 951579 | 50845 | 50860 | ACAATGACGAGGCTGG | 25 | N/A | N/A | 2660 |
| 951580 | 50979 | 50994 | TCAAATCCCATCAGGA | 90 | N/A | N/A | 2661 |
| 951581 | 51714 | 51729 | TGTACTTGCGGGTTTT | 42 | N/A | N/A | 2662 |
| 951582 | 51790 | 51805 | AGCAATCACGCTGCCA | 99 | N/A | N/A | 2663 |
| 951583 | 51798 | 51813 | AGTCATCCAGCAATCA | 43 | N/A | N/A | 2664 |
| 951584 | 51810 | 51825 | ATTAATCTGGGCAGTC | 38 | N/A | N/A | 2665 |
| 951585 | 51811 | 51826 | GATTAATCTGGGCAGT | 67 | N/A | N/A | 2666 |
| 951586 | 51816 | 51831 | TAAAGGATTAATCTGG | 48 | N/A | N/A | 2667 |
| 951587 | 51977 | 51992 | ATTTTGATAGCTCCAC | 33 | N/A | N/A | 2668 |
| 951588 | 51979 | 51994 | GCATTTTGATAGCTCC | 17 | N/A | N/A | 2669 |
| 951589 | 52601 | 52616 | GGTTTAAAAGCTTCCA | 98 | N/A | N/A | 2670 |
| 951590 | 52938 | 52953 | GTAAATGCTGAATGCC | 34 | N/A | N/A | 2671 |
| 951591 | 53084 | 53099 | GGATATGGACAGCAGG | 17 | N/A | N/A | 2672 |
| 951592 | 53085 | 53100 | AGGATATGGACAGCAG | 15 | N/A | N/A | 2673 |
| 951593 | 53553 | 53568 | TCACATGCCAGACTTT | 100 | N/A | N/A | 2674 |
| 951594 | 53781 | 53796 | CACACTCACGCATGTT | 102 | N/A | N/A | 2675 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951595 | 53852 | 53867 | TTTACCTTGAATGTCC | 46 | N/A | N/A | 2676 |
| 951596 | 54009 | 54024 | GCAAGCTACTCTCTCA | 88 | N/A | N/A | 2677 |
| 951597 | 54160 | 54175 | TCAATACCTGCACAGG | 42 | N/A | N/A | 2678 |
| 951598 | 54161 | 54176 | GTCAATACCTGCACAG | 80 | N/A | N/A | 2679 |
| 951599 | 54177 | 54192 | TGTATGAGGACTCAGA | 42 | N/A | N/A | 2680 |
| 951600 | 54189 | 54204 | ATCATAACAGGCTGTA | 28 | N/A | N/A | 2681 |
| 951601 | 54190 | 54205 | CATCATAACAGGCTGT | 94 | N/A | N/A | 2682 |
| 951602 | 54199 | 54214 | TAAAATGCGCATCATA | 51 | N/A | N/A | 2683 |
| 951603 | 54255 | 54270 | GTAATGAGCTCAGTCT | 45 | N/A | N/A | 2684 |
| 951604 | 55117 | 55132 | GAAACTACGGCACTCT | 121 | N/A | N/A | 2685 |
| 951605 | 55385 | 55400 | GGTAATAAGTCACACT | 103 | N/A | N/A | 2686 |
| 951606 | 55528 | 55543 | GATTAATATCGGCTGA | 44 | N/A | N/A | 2687 |
| 951607 | 55530 | 55545 | TGGATTAATATCGGCT | 24 | N/A | N/A | 2688 |
| 951608 | 55531 | 55546 | ATGGATTAATATCGGC | 9 | N/A | N/A | 2689 |
| 951609 | 56236 | 56251 | GTTCATCACGGAAGGT | 120 | N/A | N/A | 2690 |
| 951610 | 56274 | 56289 | CCGAATCACAGATTGA | 71 | N/A | N/A | 2691 |
| 951611 | 56324 | 56339 | GTAATTGACAAGCAGT | 16 | N/A | N/A | 2692 |
| 951612 | 56327 | 56342 | TAAGTAATTGACAAGC | 29 | N/A | N/A | 2693 |
| 951613 | 56387 | 56402 | GTATATAAGACCCGGG | 65 | N/A | N/A | 2694 |
| 951614 | 56388 | 56403 | TGTATATAAGACCCGG | 86 | N/A | N/A | 2695 |
| 951615 | 56389 | 56404 | GTGTATATAAGACCCG | 53 | N/A | N/A | 2696 |
| 951616 | 56390 | 56405 | AGTGTATATAAGACCC | 41 | N/A | N/A | 2697 |
| 951617 | 56459 | 56474 | GACTATTCAAGAGGGC | 70 | N/A | N/A | 2698 |
| 951618 | 56567 | 56582 | TCTCATGGCACTCACT | 42 | N/A | N/A | 2699 |
| 951619 | 56617 | 56632 | ATTCATGGTCCACCAG | 101 | N/A | N/A | 2700 |
| 951620 | 56685 | 56700 | GGTGATGCTGCAGAGC | 36 | N/A | N/A | 2701 |
| 951621 | 56725 | 56740 | CAGGATACATCACCCA | 128 | N/A | N/A | 2702 |
| 951622 | 56858 | 56873 | TATTATGAATCCCCCT | 90 | N/A | N/A | 2703 |
| 951623 | 56859 | 56874 | ATATTATGAATCCCCC | 100 | N/A | N/A | 2704 |
| 951624 | 56861 | 56876 | ACATATTATGAATCCC | 52 | N/A | N/A | 2705 |
| 951625 | 57375 | 57390 | AGTAATGACCCAGGCT | 74 | N/A | N/A | 2706 |
| 951626 | 57642 | 57657 | AGTGATGGGTCCCCAC | 94 | N/A | N/A | 2707 |
| 951627 | 57738 | 57753 | GTGAATATCAACTGTT | 41 | N/A | N/A | 2708 |
| 951628 | 57916 | 57931 | GCAGATCTGGCTGCCT | 71 | N/A | N/A | 2709 |
| 951629 | 58905 | 58920 | AGGATATTTGGCTGGG | 70 | N/A | N/A | 2710 |
| 951630 | 59003 | 59018 | ACTTATCGCAAGGAAC | 71 | N/A | N/A | 2711 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951631 | 59075 | 59090 | GCGATATACCTTTCTG | 26 | N/A | N/A | 2712 |
| 951632 | 59076 | 59091 | TGCGATATACCTTTCT | 19 | N/A | N/A | 2713 |
| 951633 | 59174 | 59189 | TGAATGACAGGTGTGT | 124 | N/A | N/A | 2714 |
| 951634 | 59346 | 59361 | TACAATCACAATTGCT | 47 | N/A | N/A | 2715 |
| 951635 | 60402 | 60417 | GCCAATACCAAAGAAC | 96 | N/A | N/A | 2716 |
| 951636 | 60469 | 60484 | TCTAAATCAGGACAGT | 86 | N/A | N/A | 2717 |
| 951637 | 61124 | 61139 | GCAACATGGGCACTGC | 100 | N/A | N/A | 2718 |
| 951638 | 61190 | 61205 | TAAGATCGCATCTGGG | 93 | N/A | N/A | 2719 |
| 951639 | 61274 | 61289 | AGCTATCTGGGTTAGG | 105 | N/A | N/A | 2720 |
| 951640 | 61338 | 61353 | GGAAATAGACGATCTC | 68 | N/A | N/A | 2721 |
| 951641 | 61460 | 61475 | CCAATTTGGGCATCAA | 102 | N/A | N/A | 2722 |
| 951642 | 61461 | 61476 | GCCAATTTGGGCATCA | 102 | N/A | N/A | 2723 |
| 951643 | 61530 | 61545 | GTTATATGTGTGGCAT | 35 | N/A | N/A | 2724 |
| 951644 | 61531 | 61546 | TGTTATATGTGTGGCA | 40 | N/A | N/A | 2725 |
| 951645 | 61532 | 61547 | GTGTTATATGTGTGGC | 9 | N/A | N/A | 2726 |
| 951646 | 61680 | 61695 | GCTAAAATTCCACTCT | 96 | N/A | N/A | 2727 |
| 951647 | 61796 | 61811 | CGTAAACATGATTCCT | 20 | N/A | N/A | 2728 |
| 951648 | 61841 | 61856 | GTTATTAAGGACAACC | 120 | N/A | N/A | 2729 |
| 951649 | 61857 | 61872 | CGTTATTGTCATTTGT | 46 | N/A | N/A | 2730 |
| 951650 | 61943 | 61958 | TCGAATGAAGATGGTC | 30 | N/A | N/A | 2731 |
| 951651 | 62255 | 62270 | AATGATAAGGACCCCA | 63 | N/A | N/A | 2732 |
| 951652 | 62257 | 62272 | GTAATGATAAGGACCC | 66 | N/A | N/A | 2733 |
| 951653 | 62258 | 62273 | AGTAATGATAAGGACC | 80 | N/A | N/A | 2734 |
| 951654 | 62398 | 62413 | GTTAATTGTGCACTTG | 15 | N/A | N/A | 2735 |
| 951655 | 62399 | 62414 | TGTTAATTGTGCACTT | 80 | N/A | N/A | 2736 |
| 951656 | 62400 | 62415 | GTGTTAATTGTGCACT | 109 | N/A | N/A | 2737 |
| 951657 | 62526 | 62541 | AGTTATAAACCCTGGG | 11 | N/A | N/A | 2738 |
| 951658 | 63805 | 63820 | ACAATAATTGGCCAAA | 86 | N/A | N/A | 2739 |
| 951659 | 63829 | 63844 | GATCTAATTACCAGCT | 128 | N/A | N/A | 2740 |
| 951660 | 63881 | 63896 | TACTTAGGTTACTCCT | 49 | N/A | N/A | 2741 |
| 951661 | 64400 | 64415 | GACAATGGGTCAACGC | 67 | N/A | N/A | 2742 |
| 951662 | 65042 | 65057 | TGCTCTAAATGACTGC | 96 | N/A | N/A | 2743 |
| 951663 | 65090 | 65105 | CCACATCTATCTCAGA | 112 | N/A | N/A | 2744 |
| 951664 | 65141 | 65156 | AATATCTCAGCAGTGC | 54 | N/A | N/A | 2745 |
| 951665 | 65142 | 65157 | CAATATCTCAGCAGTG | 126 | N/A | N/A | 2746 |
| 951666 | 65354 | 65369 | GGCCTAACAGTGTCCA | 105 | N/A | N/A | 2747 |
| 951667 | 65601 | 65616 | AGTCATTAGTACGCCA | 46 | N/A | N/A | 2748 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID: 2 Stop Site | SEQ ID NO |
|---|---|---|---|---|---|---|---|
| 951668 | 66403 | 66418 | GTCTTGTGGGATGTGA | 66 | N/A | N/A | 2749 |
| 951669 | 66821 | 66836 | TCAATACACACTGTTG | 85 | N/A | N/A | 2750 |
| 951670 | 66828 | 66843 | GGATAATTCAATACAC | 41 | N/A | N/A | 2751 |
| 951671 | 67824 | 67839 | ATAACATGTTACTCAG | 71 | N/A | N/A | 2752 |
| 951672 | 67825 | 67840 | CATAACATGTTACTCA | 87 | N/A | N/A | 2753 |
| 951673 | 67827 | 67842 | GTCATAACATGTTACT | 76 | N/A | N/A | 2754 |
| 951674 | 67828 | 67843 | TGTCATAACATGTTAC | 102 | N/A | N/A | 2755 |
| 951675 | 67840 | 67855 | GGCACTCACAGCTGTC | 119 | N/A | N/A | 2756 |
| 951676 | 68164 | 68179 | AGCTGTTGTGCAGTGC | 73 | N/A | N/A | 2757 |
| 951677 | 68238 | 68253 | GCTAAATGTGGACTGA | 28 | N/A | N/A | 2758 |
| 951678 | 68623 | 68638 | GGCAATGCATACAGTC | 44 | N/A | N/A | 2759 |
| 951679 | 68650 | 68665 | GTTATTAACCCCCTGT | 44 | N/A | N/A | 2760 |
| 951680 | 69011 | 69026 | TCAATTACTTACAAGA | 62 | N/A | N/A | 2761 |
| 951681 | 69030 | 69045 | TGTTTATGCACCATGT | 57 | N/A | N/A | 2762 |
| 951682 | 69227 | 69242 | GAATTATGCCTTCTAC | 25 | N/A | N/A | 2763 |
| 951683 | 69652 | 69667 | GTCTATGTGGGCTGCC | 80 | N/A | N/A | 2764 |
| 951684 | 69735 | 69750 | ATCTATGGCATGGAGC | 82 | N/A | N/A | 2765 |
| 951685 | 69737 | 69752 | ACATCTATGGCATGGA | 75 | N/A | N/A | 2766 |
| 951686 | 71409 | 71424 | ACAGATAAATCAAGCC | 50 | N/A | N/A | 2767 |
| 951687 | 71450 | 71465 | CACTATGCGGCCACCA | 93 | N/A | N/A | 2768 |
| 951688 | 71699 | 71714 | GTACATACTGCAGCAG | 113 | N/A | N/A | 2769 |
| 951689 | 71700 | 71715 | GGTACATACTGCAGCA | 107 | N/A | N/A | 2770 |
| 951690 | 71857 | 71872 | GCGAATGCCATGCTTA | 82 | N/A | N/A | 2771 |
| 951691 | 71968 | 71983 | GACATTTAACACACTA | 7 | N/A | N/A | 2772 |
| 951692 | 73303 | 73318 | GGCTTAATCCCACACG | 97 | N/A | N/A | 2773 |
| 951693 | 73694 | 73709 | GAATTTGGGATTGTGG | 21 | N/A | N/A | 2774 |
| 951694 | 73828 | 73843 | TCATGCATGGCACTGT | 102 | N/A | N/A | 2775 |
| 951695 | 73956 | 73971 | AGCATAAAAGCACTCT | 74 | N/A | N/A | 2776 |
| 951696 | 74038 | 74053 | GCTATGAATTTCCTCC | 10 | N/A | N/A | 2777 |
| 951697 | 74039 | 74054 | GGCTATGAATTTCCTC | 115 | N/A | N/A | 2778 |
| 951698 | 74365 | 74380 | TGCTATGACCCTCACT | 82 | N/A | N/A | 2779 |
| 951699 | 75020 | 75035 | ACAGATAACAGTGGCG | 24 | N/A | N/A | 2780 |
| 951700 | 75136 | 75151 | GTAATTCCCGTTCTCT | 16 | N/A | N/A | 2781 |
| 951701 | 75145 | 75160 | TCTATTACCGTAATTC | 23 | N/A | N/A | 2782 |
| 951702 | 75247 | 75262 | TACATGAACAGTCTGT | 50 | N/A | N/A | 2783 |
| 951703 | 75327 | 75342 | AACTTACAAGCATCGG | 91 | N/A | N/A | 2784 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951704 | 75329 | 75344 | TGAACTTACAAGCATC | 94 | N/A | N/A | 2785 |
| 951705 | 75417 | 75432 | ATCAATTTTAAACACG | 31 | N/A | N/A | 2786 |
| 951706 | 75765 | 75780 | ACAAATACATGAGGTC | 32 | N/A | N/A | 2787 |
| 951707 | 75894 | 75909 | GTATTATTCCCAGCTA | 77 | N/A | N/A | 2788 |
| 951708 | 75895 | 75910 | TGTATTATTCCCAGCT | 102 | N/A | N/A | 2789 |
| 951709 | 76435 | 76450 | GAGAATATCACAGGGT | 10 | N/A | N/A | 2790 |
| 951710 | 76448 | 76463 | TGTAATCAGTCAAGAG | 18 | N/A | N/A | 2791 |
| 951711 | 76550 | 76565 | GACAATTGTGACCGGC | 88 | N/A | N/A | 2792 |
| 951712 | 76568 | 76583 | CACAATCAGAGCATTC | 34 | N/A | N/A | 2793 |
| 951713 | 76593 | 76608 | TGATTTACAGGCCCAA | 37 | N/A | N/A | 2794 |
| 951714 | 76594 | 76609 | GTGATTTACAGGCCCA | 50 | N/A | N/A | 2795 |
| 951715 | 76725 | 76740 | ACTAATGACAGACAAC | 27 | N/A | N/A | 2796 |
| 951716 | 76728 | 76743 | TAAACTAATGACAGAC | 92 | N/A | N/A | 2797 |
| 951717 | 76775 | 76790 | TTGAATTGTGGACCAA | 60 | N/A | N/A | 2798 |
| 951718 | 77126 | 77141 | AGGTTAATGCTTCACC | 54 | N/A | N/A | 2799 |
| 951719 | 77303 | 77318 | TCAAATGGTGACCACT | 112 | N/A | N/A | 2800 |
| 951720 | 77432 | 77447 | CGTTTTAGTTTTCCTA | 14 | N/A | N/A | 2801 |
| 951721 | 77538 | 77553 | GTAATAACATGTGTCG | 45 | N/A | N/A | 2802 |
| 951722 | 77539 | 77554 | GGTAATAACATGTGTC | 27 | N/A | N/A | 2803 |
| 951723 | 77570 | 77585 | TAAACAATTGCTCATC | 59 | N/A | N/A | 2804 |
| 951724 | 78076 | 78091 | GGTAATTCTGCAAAGA | 29 | N/A | N/A | 2805 |
| 951725 | 78080 | 78095 | TAATGGTAATTCTGCA | 43 | N/A | N/A | 2806 |
| 951726 | 78082 | 78097 | ACTAATGGTAATTCTG | 50 | N/A | N/A | 2807 |
| 951727 | 78166 | 78181 | TTAGATCTCATTACCT | 71 | N/A | N/A | 2808 |
| 951728 | 78206 | 78221 | GTAACAACATCTACCT | 88 | N/A | N/A | 2809 |
| 951729 | 78207 | 78222 | GGTAACAACATCTACC | 3 | N/A | N/A | 2810 |
| 951730 | 78387 | 78402 | TGATTTACAGGATGCT | 15 | N/A | N/A | 2811 |
| 951731 | 78388 | 78403 | TTGATTTACAGGATGC | 8 | N/A | N/A | 2812 |
| 951732 | 78539 | 78554 | GCAAATGCTGGCTACG | 85 | N/A | N/A | 2813 |
| 951733 | 78546 | 78561 | CCCAATGGCAAATGCT | 66 | N/A | N/A | 2814 |
| 951734 | 78848 | 78863 | GGCACTACCTTCACCA | 109 | N/A | N/A | 2815 |
| 951735 | 79046 | 79061 | TCATATTGTTCTGCCC | 15 | N/A | N/A | 2816 |
| 951736 | 79047 | 79062 | TTCATATTGTTCTGCC | 11 | N/A | N/A | 2817 |
| 951737 | 79077 | 79092 | GGCTTTTGTCAGAGGA | 8 | N/A | N/A | 2818 |
| 951738 | 79153 | 79168 | TTCAATGACATGCTAG | 19 | N/A | N/A | 2819 |
| 951739 | 79209 | 79224 | TATATCAGCTCAGTGC | 75 | N/A | N/A | 2820 |
| 951740 | 79211 | 79226 | TATATATCAGCTCAGT | 66 | N/A | N/A | 2821 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951741 | 79214 | 79229 | TTGTATATATCAGCTC | 37 | N/A | N/A | 2822 |
| 951742 | 79229 | 79244 | TCATACATAAGGATGT | 91 | N/A | N/A | 2823 |
| 951743 | 79398 | 79413 | GCTCATTGTAAACAGT | 20 | N/A | N/A | 2824 |
| 951744 | 79462 | 79477 | TGCATTTGGTCTTGCT | 118 | N/A | N/A | 2825 |
| 951745 | 79799 | 79814 | GACTATCAGTATGCAC | 118 | N/A | N/A | 2826 |
| 951746 | 79845 | 79860 | CATCATATTGGTGGGA | 11 | N/A | N/A | 2827 |
| 951747 | 80265 | 80280 | GCTATATTCACAAGGC | 70 | N/A | N/A | 2828 |
| 951748 | 80266 | 80281 | GGCTATATTCACAAGG | 39 | N/A | N/A | 2829 |
| 951749 | 80520 | 80535 | AACGATTAGGGACTCA | 4 | N/A | N/A | 2830 |
| 951750 | 80663 | 80678 | CCCTATTTGATCAGGA | 117 | N/A | N/A | 2831 |
| 951751 | 80845 | 80860 | GCAACTACCTTTGTTA | 17 | N/A | N/A | 2832 |
| 951752 | 80986 | 81001 | AGCAATTTCATTGGCC | 105 | N/A | N/A | 2833 |
| 951753 | 81192 | 81207 | AGCAATACCTTACTGG | 46 | N/A | N/A | 2834 |
| 951754 | 81436 | 81451 | TGGTATCAGGGTCCCA | 130 | N/A | N/A | 2835 |
| 951755 | 81663 | 81678 | CATGATGTCGCTGGCA | 41 | N/A | N/A | 2836 |
| 951756 | 81741 | 81756 | TCCAAAAATGGGCTGC | 28 | N/A | N/A | 2837 |
| 951757 | 82016 | 82031 | TCTAATCGAAGAAGCT | 99 | N/A | N/A | 2838 |
| 951758 | 82262 | 82277 | TCTGATTAGTCCATGC | 40 | N/A | N/A | 2839 |
| 951759 | 82535 | 82550 | ACAAATGCGGAGATGA | 41 | N/A | N/A | 2840 |
| 951761 | 82653 | 82668 | GCCAATGCAAGGTGGC | 119 | N/A | N/A | 2841 |
| 951762 | 82803 | 82818 | TGTTTTGGTGCTGGCT | 99 | N/A | N/A | 2842 |
| 951763 | 82880 | 82895 | TGGAATGGTTACTCTC | 3 | N/A | N/A | 2843 |
| 951764 | 82920 | 82935 | ATCTTCTGCAGTGTGG | 2 | N/A | N/A | 2844 |
| 951765 | 83070 | 83085 | GGTATCTGGGCCATCA | 101 | N/A | N/A | 2845 |
| 951766 | 83419 | 83434 | AGCAACATGAACCACA | 26 | N/A | N/A | 2846 |
| 951767 | 84425 | 84440 | GTAATCAAGGCAGCAA | 7 | N/A | N/A | 2847 |
| 951768 | 85210 | 85225 | AGCTCTGGTTTCAACA | 82 | N/A | N/A | 2848 |
| 951769 | 85217 | 85232 | TTAATTAAGCTCTGGT | 12 | N/A | N/A | 2849 |
| 951770 | 85218 | 85233 | CTTAATTAAGCTCTGG | 22 | N/A | N/A | 2850 |
| 951771 | 85220 | 85235 | GGCTTAATTAAGCTCT | 67 | N/A | N/A | 2851 |
| 951772 | 85238 | 85253 | AGTGACATAGCAAGCA | 7 | N/A | N/A | 2852 |
| 951773 | 85417 | 85432 | AAGAATCAGACTCTTC | 110 | N/A | N/A | 2853 |
| 951774 | 85726 | 85741 | CATTTATAACAGGCA | 82 | N/A | N/A | 2854 |
| 951775 | 85727 | 85742 | CCATTTATAACAGGCC | 94 | N/A | N/A | 2855 |
| 951776 | 85844 | 85859 | GGCTTATGAGTCCACT | 91 | N/A | N/A | 2856 |
| 951777 | 85973 | 85988 | TGCATTAAAACTGCGA | 87 | N/A | N/A | 2857 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951778 | 86550 | 86565 | AACAATCATAGCCTCA | 114 | N/A | N/A | 2858 |
| 951779 | 86582 | 86597 | AACTTACTGTCTCCCA | 37 | N/A | N/A | 2859 |
| 951780 | 86937 | 86952 | GTTTAATAATGTGCAG | 40 | N/A | N/A | 2860 |
| 951781 | 86938 | 86953 | GGTTTAATAATGTGCA | 11 | N/A | N/A | 2861 |
| 951782 | 86939 | 86954 | GGGTTTAATAATGTGC | 27 | N/A | N/A | 2862 |
| 951783 | 87671 | 87686 | TCGCTAAAGGCTCTGA | 10 | N/A | N/A | 2863 |
| 951784 | 87858 | 87873 | TGAAATCAGGGCTCCC | 31 | N/A | N/A | 2864 |
| 951785 | 88030 | 88045 | CTCTATCACAGGGCCC | 92 | N/A | N/A | 2865 |
| 951786 | 88032 | 88047 | TGCTCTATCACAGGGC | 30 | N/A | N/A | 2866 |
| 951787 | 88258 | 88273 | TGTATCTGGTGACTCC | 5 | N/A | N/A | 2867 |
| 951788 | 88270 | 88285 | ACCGATAAATGTTGTA | 65 | N/A | N/A | 2868 |
| 951789 | 88634 | 88649 | TATAGTAACAGCTGGG | 73 | N/A | N/A | 2869 |
| 951790 | 88637 | 88652 | CAGTATAGTAACAGCT | 94 | N/A | N/A | 2870 |
| 951791 | 88638 | 88653 | TCAGTATAGTAACAGC | 41 | N/A | N/A | 2871 |
| 951792 | 88880 | 88895 | TGTTTAAGGACTCCAC | 28 | N/A | N/A | 2872 |
| 951793 | 88887 | 88902 | GACAATTTGTTTAAGG | 5 | N/A | N/A | 2873 |
| 951794 | 89152 | 89167 | GATCTAATCAGAAGCA | 29 | N/A | N/A | 2874 |
| 951795 | 89558 | 89573 | TGAGATTACGCACCAC | 5 | N/A | N/A | 2875 |
| 951796 | 89718 | 89733 | ATTATAGGGCTTCTTA | 30 | N/A | N/A | 2876 |
| 951797 | 89720 | 89735 | TTATTATAGGGCTTCT | 8 | N/A | N/A | 2877 |
| 951798 | 89721 | 89736 | TTTATTATAGGGCTTC | 1 | N/A | N/A | 2878 |
| 951799 | 89722 | 89737 | GTTTATTATAGGGCTT | 1 | N/A | N/A | 2879 |
| 951800 | 89746 | 89761 | AGTGATATTCCCAACA | 19 | N/A | N/A | 2880 |
| 951801 | 89977 | 89992 | CATATATCTCCTGTTA | 20 | N/A | N/A | 2881 |
| 951802 | 89999 | 90014 | TCATATCACCACTTGC | 29 | N/A | N/A | 2882 |
| 951803 | 90003 | 90018 | ACAATCATATCACCAC | 6 | N/A | N/A | 2883 |
| 951804 | 90004 | 90019 | GACAATCATATCACCA | 3 | N/A | N/A | 2884 |
| 951805 | 90058 | 90073 | TTATATGTGGACACCT | 34 | N/A | N/A | 2885 |
| 951806 | 90059 | 90074 | TTTATATGTGGACACC | 10 | N/A | N/A | 2886 |
| 951807 | 90139 | 90154 | CACAATCCCAGATCTC | 7 | N/A | N/A | 2887 |
| 951808 | 90161 | 90176 | TCTATAAGGTTCCTTA | 14 | N/A | N/A | 2888 |
| 951809 | 90165 | 90180 | TGTTTCTATAAGGTTC | 3 | N/A | N/A | 2889 |
| 951810 | 90199 | 90214 | CCAAATTTAGAGGACA | 46 | N/A | N/A | 2890 |
| 951811 | 90222 | 90237 | ACATATCTTGCATGAC | 4 | N/A | N/A | 2891 |
| 951812 | 90264 | 90279 | TTAGACATCAGACTGT | 76 | N/A | N/A | 2892 |
| 951813 | 90267 | 90282 | GTCTTAGACATCAGAC | 115 | N/A | N/A | 2893 |
| 951814 | 90706 | 90721 | TCAATTGAGGCTTCTA | 7 | N/A | N/A | 2894 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951815 | 90716 | 90731 | TGTATCTGGTTCAATT | 11 | N/A | N/A | 2895 |
| 951816 | 90721 | 90736 | GTAAATGTATCTGGTT | 2 | N/A | N/A | 2896 |
| 951817 | 91071 | 91086 | GGTACTGAGGCTGTGG | 28 | N/A | N/A | 2897 |
| 951818 | 91117 | 91132 | CAGAATTATCAATTCC | 145 | N/A | N/A | 2898 |
| 951819 | 91174 | 91189 | GGTGGGTAAAATGTGC | 63 | N/A | N/A | 2899 |
| 951820 | 91191 | 91206 | GCACATAGGGCCTTCT | 79 | N/A | N/A | 2900 |
| 951821 | 91909 | 91924 | GACAATGTAGTTTCCA | 2 | N/A | N/A | 2901 |
| 951822 | 91939 | 91954 | AACTATCCCAAGCTCC | 10 | N/A | N/A | 2902 |
| 951823 | 91945 | 91960 | GGCTTCAACTATCCCA | 39 | N/A | N/A | 2903 |
| 951824 | 92037 | 92052 | ATTGATACAGCCGTTC | 8 | N/A | N/A | 2904 |
| 951825 | 92827 | 92842 | ATGATAAAGGCTGGCA | 21 | N/A | N/A | 2905 |
| 951826 | 92828 | 92843 | AATGATAAAGGCTGGC | 127 | N/A | N/A | 2906 |
| 951827 | 93169 | 93184 | AAGATTATGGTTTCCT | 4 | N/A | N/A | 2907 |
| 951828 | 93170 | 93185 | GAAGATTATGGTTTCC | 6 | N/A | N/A | 2908 |
| 951829 | 93241 | 93256 | GTACATGGTGGAGTCC | 83 | N/A | N/A | 2909 |
| 951830 | 93321 | 93336 | TGTATTACCTACGGCA | 6 | N/A | N/A | 2910 |
| 951831 | 93392 | 93407 | GCTATTAATCATATTC | 18 | N/A | N/A | 2911 |
| 951832 | 93572 | 93587 | TACTTACCAGGATCTC | 24 | N/A | N/A | 2912 |
| 951833 | 93746 | 93761 | ACTTATACCCAGGGCA | 7 | N/A | N/A | 2913 |
| 951834 | 93747 | 93762 | GACTTATACCCAGGGC | 81 | N/A | N/A | 2914 |
| 951835 | 93923 | 93938 | ATGAATTCTGGTCTGG | 2 | N/A | N/A | 2915 |
| 951836 | 94043 | 94058 | TCAACTAGCCATGTCT | 25 | N/A | N/A | 2916 |
| 951837 | 94169 | 94184 | CACTTAGCCACATCTG | 5 | N/A | N/A | 2917 |
| 951838 | 94174 | 94189 | TTAATCACTTAGCCAC | 8 | N/A | N/A | 2918 |
| 951839 | 94177 | 94192 | ACCTTAATCACTTAGC | 5 | N/A | N/A | 2919 |
| 951840 | 94182 | 94197 | ACAATACCTTAATCAC | 7 | N/A | N/A | 2920 |
| 951841 | 94284 | 94299 | CAATTTATCTGGAGGA | 8 | N/A | N/A | 2921 |
| 951842 | 94350 | 94365 | TCAATTAGTGTTGCCT | 119 | N/A | N/A | 2922 |
| 951843 | 94351 | 94366 | ATCAATTAGTGTTGCC | 5 | N/A | N/A | 2923 |
| 951844 | 94423 | 94438 | GTCAATCGACTGGTAC | 41 | N/A | N/A | 2924 |
| 951845 | 94446 | 94461 | ATATGATTCATCTCGG | 2 | N/A | N/A | 2925 |
| 951846 | 94447 | 94462 | AATATGATTCATCTCG | 2 | N/A | N/A | 2926 |
| 951847 | 94583 | 94598 | AGCTATGAGTAGCAGG | 18 | N/A | N/A | 2927 |
| 951848 | 94885 | 94900 | GCCAACTAATTCCTCC | 31 | N/A | N/A | 2928 |
| 951849 | 96000 | 96015 | GCCATTCACGGGCTGC | 104 | N/A | N/A | 2929 |
| 951850 | 96084 | 96099 | CAAGGGTACAGACTTA | 152 | N/A | N/A | 2930 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951851 | 96224 | 96239 | GGCTGGATGTGAGTGC | 63 | N/A | N/A | 2931 |
| 951852 | 96650 | 96665 | ACAACTAACGGCAGGC | 17 | N/A | N/A | 2932 |
| 951853 | 96755 | 96770 | ACACATCAGGGTTTCA | 56 | N/A | N/A | 2933 |
| 951854 | 97483 | 97498 | TCCTAATGGTGACTCA | 40 | N/A | N/A | 2934 |
| 951855 | 97854 | 97869 | TACAATGTAAGCCTTT | 7 | N/A | N/A | 2935 |
| 951856 | 98522 | 98537 | GTATTTCAAAGTAGTC | 4 | N/A | N/A | 2936 |
| 951857 | 98652 | 98667 | GGTTTTAATAGACACA | 6 | N/A | N/A | 2937 |
| 951858 | 98653 | 98668 | GGGTTTTAATAGACAC | 53 | N/A | N/A | 2938 |
| 951859 | 99483 | 99498 | GTTAACAACAATTGTC | 60 | N/A | N/A | 2939 |
| 951860 | 99712 | 99727 | ACAGATCTTGCATGTT | 84 | N/A | N/A | 2940 |
| 951861 | 99888 | 99903 | AGCTATCACACAGAAG | 95 | N/A | N/A | 2941 |
| 951862 | 100033 | 100048 | GCAAATCCATTGCCCA | 78 | N/A | N/A | 2942 |
| 951863 | 100171 | 100186 | GTGTTAAGGTGGCAAC | 43 | N/A | N/A | 2943 |
| 951864 | 100222 | 100237 | CTACATGGTGATGGGT | 20 | N/A | N/A | 2944 |
| 951865 | 100285 | 100300 | GTTAGCTGGACTCACA | 89 | N/A | N/A | 2945 |
| 951866 | 100375 | 100390 | CAATATCCTGGTGACT | 36 | N/A | N/A | 2946 |
| 951867 | 100514 | 100529 | ACACATGCAGTGAGCC | 60 | N/A | N/A | 2947 |
| 951868 | 101384 | 101399 | TGTATGGTGGCTCAGC | 26 | N/A | N/A | 2948 |
| 951869 | 101385 | 101400 | TTGTATGGTGGCTCAG | 44 | N/A | N/A | 2949 |
| 951870 | 101796 | 101811 | TGCAATGCTGCCAGGC | 72 | N/A | N/A | 2950 |
| 951871 | 102161 | 102176 | AGAGATATTGATGTCT | 51 | N/A | N/A | 2951 |
| 951872 | 102425 | 102440 | GCACATTGGTTAGGCT | 93 | N/A | N/A | 2952 |
| 951873 | 102445 | 102460 | CTCAATGTGTACAGTA | 22 | N/A | N/A | 2953 |
| 951874 | 102885 | 102900 | TGGAACTGTTTACAGT | 10 | N/A | N/A | 2954 |
| 951875 | 102926 | 102941 | CAAGTAACTGAGTCAC | 7 | N/A | N/A | 2955 |
| 951876 | 103421 | 103436 | ATCTATCCAAGGAGGA | 93 | N/A | N/A | 2956 |
| 951877 | 103897 | 103912 | TCAGTTCACGGATCCC | 42 | N/A | N/A | 2957 |
| 951878 | 104120 | 104135 | TGCTTTCTAAGGTTGG | 14 | N/A | N/A | 2958 |
| 951879 | 104441 | 104456 | TTTTATCTGGGCTCCA | 39 | N/A | N/A | 2959 |
| 951880 | 104447 | 104462 | TGGAACTTTTATCTGG | 17 | N/A | N/A | 2960 |
| 951881 | 104452 | 104467 | GTGAATGGAACTTTTA | 5 | N/A | N/A | 2961 |
| 951882 | 104843 | 104858 | TGTATATGAGCCCATC | 99 | N/A | N/A | 2962 |
| 951883 | 105539 | 105554 | TCATATCCATGCCCAC | 31 | N/A | N/A | 2963 |
| 951884 | 105559 | 105574 | ACAATTGGTGCCTTTC | 14 | N/A | N/A | 2964 |
| 951885 | 105560 | 105575 | CACAATTGGTGCCTTT | 20 | N/A | N/A | 2965 |
| 951886 | 105730 | 105745 | GGACATCACACTCCTC | 100 | N/A | N/A | 2966 |
| 951887 | 105777 | 105792 | CGCAATGGTGACTGCC | 114 | N/A | N/A | 2967 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951888 | 105791 | 105806 | TGAAATACCATCCACG | 40 | N/A | N/A | 2968 |
| 951889 | 105793 | 105808 | CTTGAAATACCATCCA | 19 | N/A | N/A | 2969 |
| 951890 | 106015 | 106030 | GCCTTTACTGACAGCT | 71 | N/A | N/A | 2970 |
| 951891 | 106173 | 106188 | ACAAATGGGTCTCGAG | 101 | N/A | N/A | 2971 |
| 951892 | 106195 | 106210 | GGTTTTCACGGCCAGC | 44 | N/A | N/A | 2972 |
| 951893 | 106203 | 106218 | GCTATGAAGGTTTTCA | 10 | N/A | N/A | 2973 |
| 951894 | 106204 | 106219 | AGCTATGAAGGTTTTC | 20 | N/A | N/A | 2974 |
| 951895 | 106233 | 106248 | TGTCATATGGCCAGGG | 17 | N/A | N/A | 2975 |
| 951896 | 106295 | 106310 | TAATATTGTCACCCTC | 93 | N/A | N/A | 2976 |
| 951897 | 106296 | 106311 | ATAATATTGTCACCCT | 29 | N/A | N/A | 2977 |
| 951898 | 106351 | 106366 | GTTTTTGCAGCTACTA | 9 | N/A | N/A | 2978 |
| 951899 | 106371 | 106386 | ACTATCAACCATCTTA | 20 | N/A | N/A | 2979 |
| 951900 | 106391 | 106406 | GGACTTAATTTACACA | 12 | N/A | N/A | 2980 |
| 951901 | 106392 | 106407 | TGGACTTAATTTACAC | 30 | N/A | N/A | 2981 |
| 951902 | 106404 | 106419 | GATACTAAAGTCTGGA | 11 | N/A | N/A | 2982 |
| 951903 | 107100 | 107115 | GCAGATGGTGGTCTAC | 69 | N/A | N/A | 2983 |
| 951904 | 109198 | 109213 | GCATTTTAATATTGGG | 31 | N/A | N/A | 2984 |
| 951905 | 109409 | 109424 | GGTTTAAGCGATCTCC | 46 | N/A | N/A | 2985 |
| 951906 | 109955 | 109970 | CCAATAACTGACCTCA | 72 | N/A | N/A | 2986 |
| 951907 | 109956 | 109971 | ACCAATAACTGACCTC | 54 | N/A | N/A | 2987 |
| 951908 | 111211 | 111226 | AGTTATTCTGATGCCA | 3 | N/A | N/A | 2988 |
| 951909 | 111349 | 111364 | GGGTATGGTTGCAACC | 92 | N/A | N/A | 2989 |
| 951910 | 111384 | 111399 | TCATTAGGACACAGCG | 20 | N/A | N/A | 2990 |
| 951911 | 111385 | 111400 | ATCATTAGGACACAGC | 6 | N/A | N/A | 2991 |
| 951912 | 111494 | 111509 | TACTATCAGTACAGCT | 83 | N/A | N/A | 2992 |
| 951913 | 111496 | 111511 | GATACTATCAGTACAG | 42 | N/A | N/A | 2993 |
| 951914 | 111499 | 111514 | GGAGATACTATCAGTA | 115 | N/A | N/A | 2994 |
| 951915 | 111500 | 111515 | TGGAGATACTATCAGT | 27 | N/A | N/A | 2995 |
| 951916 | 112149 | 112164 | GTGAACACTGATCACT | 86 | N/A | N/A | 2996 |
| 951917 | 112185 | 112200 | GGTATATGAGGAAACA | 18 | N/A | N/A | 2997 |
| 951918 | 112208 | 112223 | CCGTATATGTCTCCGA | 8 | N/A | N/A | 2998 |
| 951919 | 112209 | 112224 | ACCGTATATGTCTCCG | 7 | N/A | N/A | 2999 |
| 951920 | 112293 | 112308 | GGCAATTGTCTCTCTT | 47 | N/A | N/A | 3000 |
| 951921 | 112316 | 112331 | TGTATAAGCTCACTTT | 40 | N/A | N/A | 3001 |
| 951922 | 112318 | 112333 | CATGTATAAGCTCACT | 105 | N/A | N/A | 3002 |
| 951923 | 112320 | 112335 | AGCATGTATAAGCTCA | 36 | N/A | N/A | 3003 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 951924 | 112369 | 112384 | ATAATTATGTCCCATC | 24 | N/A | N/A | 3004 |
| 951925 | 112370 | 112385 | GATAATTATGTCCCAT | 5 | N/A | N/A | 3005 |
| 951926 | 112371 | 112386 | GGATAATTATGTCCCA | 61 | N/A | N/A | 3006 |
| 951927 | 112372 | 112387 | TGGATAATTATGTCCC | 102 | N/A | N/A | 3007 |
| 951928 | 112373 | 112388 | ATGGATAATTATGTCC | 105 | N/A | N/A | 3008 |
| 951929 | 112950 | 112965 | ACTACTAGTTTCTGTT | 91 | N/A | N/A | 3009 |
| 951930 | 112951 | 112966 | CACTACTAGTTTCTGT | 37 | N/A | N/A | 3010 |
| 951931 | 113712 | 113727 | GGTTATGAGATTCTTA | 4 | N/A | N/A | 3011 |
| 951932 | 113713 | 113728 | TGGTTATGAGATTCTT | 5 | N/A | N/A | 3012 |
| 951933 | 114474 | 114489 | TTTATTCACAGGGTCC | 29 | N/A | N/A | 3013 |
| 951934 | 114476 | 114491 | TATTTATTCACAGGGT | 28 | N/A | N/A | 3014 |
| 951935 | 114477 | 114492 | GTATTTATTCACAGGG | 18 | N/A | N/A | 3015 |
| 951936 | 114510 | 114525 | GCCAATGGAAGGCACC | 129 | N/A | N/A | 3016 |
| 951937 | 114524 | 114539 | TCCATTTGGGCTGTGC | 86 | N/A | N/A | 3017 |
| 951938 | 114750 | 114765 | TGCGATATCCTCCCCT | 15 | N/A | N/A | 3018 |
| 951939 | 115717 | 115732 | GAGAATAAAGCCTGGC | 80 | N/A | N/A | 3019 |
| 908415 | 83669 83757 83845 | 83684 83772 83860 | GATTGAGGTAAGGGTT | 20 | N/A N/A N/A | N/A N/A N/A | 3020 |
| 908426 | 83689 83777 83865 | 83704 83792 83880 | ACGGAACCGCTCTGTA | 88 | N/A N/A N/A | N/A N/A N/A | 509 |
| 908428 | 83691 83779 83867 | 83706 83794 83882 | TGACGGAACCGCTCTG | 73 | N/A N/A N/A | N/A N/A N/A | 511 |
| 908507 | 103213 103251 | 103228 103266 | AGCAGAGCATAGGAGA | 20 | N/A N/A | N/A N/A | 590 |
| 949039 | 7946 8587 | 7961 8602 | AAGTGCTATTATAACT | 100 | N/A N/A | N/A N/A | 3021 |
| 949040 | 7947 8588 | 7962 8603 | GAAGTGCTATTATAAC | 8 | N/A N/A | N/A N/A | 3022 |
| 949041 | 7948 8589 | 7963 8604 | AGAAGTGCTATTATAA | 6 | N/A N/A | N/A N/A | 3023 |
| 949042 | 7949 8590 | 7964 8605 | AAGAAGTGCTATTATA | 15 | N/A N/A | N/A N/A | 3024 |
| 949043 | 7950 8591 | 7965 8606 | AAAGAAGTGCTATTAT | 37 | N/A N/A | N/A N/A | 3025 |
| 949044 | 7951 8592 | 7966 8607 | GAAAGAAGTGCTATTA | 19 | N/A N/A | N/A N/A | 3026 |
| 949045 | 7952 8593 | 7967 8608 | GGAAAGAAGTGCTATT | 20 | N/A N/A | N/A N/A | 3027 |
| 949046 | 7953 8594 | 7968 8609 | GGGAAAGAAGTGCTAT | 36 | N/A N/A | N/A N/A | 3028 |
| 949047 | 7954 8595 | 7969 8610 | AGGGAAAGAAGTGCTA | 64 | N/A N/A | N/A N/A | 3029 |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949048 | 7955 | 7970 | AAGGGAAAGAAGTGCT | 22 | N/A | N/A | 3030 |
|  | 8596 | 8611 |  |  | N/A | N/A |  |
| 949049 | 7956 | 7971 | AAAGGGAAAGAAGTGC | 21 | N/A | N/A | 3031 |
|  | 8597 | 8612 |  |  | N/A | N/A |  |
| 949060 | 9158 | 9173 | TAAAATGTACCCCCTC | 42 | N/A | N/A | 3032 |
|  | 9478 | 9493 |  |  | N/A | N/A |  |
| 949133 | 16330 | 16345 | GAAAAGAACAACCTGG | 21 | N/A | N/A | 3033 |
|  | 16655 | 16670 |  |  | N/A | N/A |  |
| 949913 | 83642 | 83657 | TGCAGCTGTCAGCATG | 61 | N/A | N/A | 3034 |
|  | 83730 | 83745 |  |  | N/A | N/A |  |
|  | 83818 | 83833 |  |  | N/A | N/A |  |
| 949914 | 83643 | 83658 | ATGCAGCTGTCAGCAT | 113 | N/A | N/A | 3035 |
|  | 83731 | 83746 |  |  | N/A | N/A |  |
|  | 83819 | 83834 |  |  | N/A | N/A |  |
| 949915 | 83644 | 83659 | TATGCAGCTGTCAGCA | 59 | N/A | N/A | 3036 |
|  | 83732 | 83747 |  |  | N/A | N/A |  |
|  | 83820 | 83835 |  |  | N/A | N/A |  |
| 949916 | 83645 | 83660 | ATATGCAGCTGTCAGC | 16 | N/A | N/A | 3037 |
|  | 83733 | 83748 |  |  | N/A | N/A |  |
|  | 83821 | 83836 |  |  | N/A | N/A |  |
| 949917 | 83648 | 83663 | GCCATATGCAGCTGTC | 13 | N/A | N/A | 3038 |
|  | 83736 | 83751 |  |  | N/A | N/A |  |
|  | 83824 | 83839 |  |  | N/A | N/A |  |
| 949918 | 83652 | 83667 | CTTTGCCATATGCAGC | 8 | N/A | N/A | 3039 |
|  | 83740 | 83755 |  |  | N/A | N/A |  |
|  | 83828 | 83843 |  |  | N/A | N/A |  |
| 949919 | 83653 | 83668 | ACTTTGCCATATGCAG | 15 | N/A | N/A | 3040 |
|  | 83741 | 83756 |  |  | N/A | N/A |  |
|  | 83829 | 83844 |  |  | N/A | N/A |  |
| 949920 | 83654 | 83669 | TACTTTGCCATATGCA | 4 | N/A | N/A | 3041 |
|  | 83742 | 83757 |  |  | N/A | N/A |  |
|  | 83830 | 83845 |  |  | N/A | N/A |  |
| 949921 | 83655 | 83670 | TTACTTTGCCATATGC | 1 | N/A | N/A | 3042 |
|  | 83743 | 83758 |  |  | N/A | N/A |  |
|  | 83831 | 83846 |  |  | N/A | N/A |  |
| 949922 | 83656 | 83671 | GTTACTTTGCCATATG | 4 | N/A | N/A | 3043 |
|  | 83744 | 83759 |  |  | N/A | N/A |  |
|  | 83832 | 83847 |  |  | N/A | N/A |  |
| 949923 | 83657 | 83672 | GGTTACTTTGCCATAT | 8 | N/A | N/A | 3044 |
|  | 83745 | 83760 |  |  | N/A | N/A |  |
|  | 83833 | 83848 |  |  | N/A | N/A |  |
| 949924 | 83668 | 83683 | ATTGAGGTAAGGGTTA | 4 | N/A | N/A | 3045 |
|  | 83756 | 83771 |  |  | N/A | N/A |  |
|  | 83844 | 83859 |  |  | N/A | N/A |  |
| 949925 | 83675 | 83690 | TATCTTGATTGAGGTA | 6 | N/A | N/A | 3046 |
|  | 83763 | 83778 |  |  | N/A | N/A |  |
|  | 83851 | 83866 |  |  | N/A | N/A |  |
| 949926 | 83676 | 83691 | GTATCTTGATTGAGGT | 2 | N/A | N/A | 3047 |
|  | 83764 | 83779 |  |  | N/A | N/A |  |
|  | 83852 | 83867 |  |  | N/A | N/A |  |
| 949927 | 83677 | 83692 | TGTATCTTGATTGAGG | 1 | N/A | N/A | 3048 |
|  | 83765 | 83780 |  |  | N/A | N/A |  |
|  | 83853 | 83868 |  |  | N/A | N/A |  |

TABLE 3-continued

DNM2 mRNA Expression

| Compound Number | SEQ ID: 1 Start Site | SEQ ID: 1 Stop Site | Sequence | Dynamin2 (% Control) | SEQ ID: 2 Start Site | SEQ ID 2: Stop Site | SEQ ID NO |
|---|---|---|---|---|---|---|---|
| 949928 | 83678 | 83693 | CTGTATCTTGATTGAG | 4 | N/A | N/A | 3049 |
|  | 83766 | 83781 |  |  | N/A | N/A |  |
|  | 83854 | 83869 |  |  | N/A | N/A |  |
| 949929 | 83682 | 83697 | CGCTCTGTATCTTGAT | 2 | N/A | N/A | 3050 |
|  | 83770 | 83785 |  |  | N/A | N/A |  |
|  | 83858 | 83873 |  |  | N/A | N/A |  |
| 949930 | 83683 | 83698 | CCGCTCTGTATCTTGA | 9 | N/A | N/A | 3051 |
|  | 83771 | 83786 |  |  | N/A | N/A |  |
|  | 83859 | 83874 |  |  | N/A | N/A |  |
| 949931 | 83700 | 83715 | TTTAGGAGGTGACGGA | 6 | N/A | N/A | 3052 |
|  | 83788 | 83803 |  |  | N/A | N/A |  |
|  | 83876 | 83891 |  |  | N/A | N/A |  |
| 949932 | 83701 | 83716 | TTTTAGGAGGTGACGG | 7 | N/A | N/A | 3053 |
|  | 83789 | 83804 |  |  | N/A | N/A |  |
|  | 83877 | 83892 |  |  | N/A | N/A |  |
| 949933 | 83702 | 83717 | ATTTTAGGAGGTGACG | 17 | N/A | N/A | 3054 |
|  | 83878 | 83893 |  |  | N/A | N/A |  |
| 949934 | 83703 | 83718 | GATTTTAGGAGGTGAC | 15 | N/A | N/A | 3055 |
|  | 83879 | 83894 |  |  | N/A | N/A |  |
| 949935 | 83704 | 83719 | GGATTTTAGGAGGTGA | 6 | N/A | N/A | 3056 |
|  | 83880 | 83895 |  |  | N/A | N/A |  |
| 949936 | 83705 | 83720 | GGGATTTTAGGAGGTG | 15 | N/A | N/A | 3057 |
|  | 83881 | 83896 |  |  | N/A | N/A |  |
| 949937 | 83706 | 83721 | AGGGATTTTAGGAGGT | 8 | N/A | N/A | 3058 |
|  | 83882 | 83897 |  |  | N/A | N/A |  |
| 949938 | 83707 | 83722 | CAGGGATTTTAGGAGG | 12 | N/A | N/A | 3059 |
|  | 83883 | 83898 |  |  | N/A | N/A |  |
| 949939 | 83708 | 83723 | ACAGGGATTTTAGGAG | 18 | N/A | N/A | 3060 |
|  | 83884 | 83899 |  |  | N/A | N/A |  |
| 949940 | 83728 | 83743 | CAGCTGTCAGCATGAT | 63 | N/A | N/A | 3061 |
|  | 83816 | 83831 |  |  | N/A | N/A |  |
| 949941 | 83729 | 83744 | GCAGCTGTCAGCATGA | 67 | N/A | N/A | 3062 |
|  | 83817 | 83832 |  |  | N/A | N/A |  |
| 950194 | 103191 | 103206 | CGGTGGCCATGGAGGG | 67 | N/A | N/A | 3063 |
|  | 103229 | 103244 |  |  | N/A | N/A |  |
|  | 103267 | 103282 |  |  | N/A | N/A |  |
| 950195 | 103192 | 103207 | CCGGTGGCCATGGAGG | 98 | N/A | N/A | 3064 |
|  | 103230 | 103245 |  |  | N/A | N/A |  |
|  | 103268 | 103283 |  |  | N/A | N/A |  |
| 950196 | 103193 | 103208 | CCCGGTGGCCATGGAG | 91 | N/A | N/A | 3065 |
|  | 103231 | 103246 |  |  | N/A | N/A |  |
|  | 103269 | 103284 |  |  | N/A | N/A |  |
| 950197 | 103194 | 103209 | GCCCGGTGGCCATGGA | 122 | N/A | N/A | 3066 |
|  | 103232 | 103247 |  |  | N/A | N/A |  |
|  | 103270 | 103285 |  |  | N/A | N/A |  |
| 950198 | 103195 | 103210 | GGCCCGGTGGCCATGG | 106 | N/A | N/A | 3067 |
|  | 103233 | 103248 |  |  | N/A | N/A |  |
|  | 103271 | 103286 |  |  | N/A | N/A |  |
| 950199 | 103196 | 103211 | GGGCCCGGTGGCCATG | 125 | N/A | N/A | 3068 |
|  | 103234 | 103249 |  |  | N/A | N/A |  |
|  | 103272 | 103287 |  |  | N/A | N/A |  |
| 950200 | 103210 | 103225 | AGAGCATAGGAGAGGG | 20 | N/A | N/A | 3069 |
|  | 103248 | 103263 |  |  | N/A | N/A |  |

TABLE 3-continued

DNM2 mRNA Expression

| Compound Number | SEQ ID: 1 Start Site | SEQ ID: 1 Stop Site | Sequence | Dynamin2 (% Control) | SEQ ID 2 Start Site | SEQ ID 2: Stop Site | SEQ ID NO |
|---|---|---|---|---|---|---|---|
| 950201 | 103212 103250 | 103227 103265 | GCAGAGCATAGGAGAG | 21 | N/A N/A | N/A N/A | 3070 |
| 950202 | 103214 103252 | 103229 103267 | GAGCAGAGCATAGGAG | 23 | N/A N/A | N/A N/A | 3071 |
| 950203 | 103215 103253 | 103230 103268 | GGAGCAGAGCATAGGA | 22 | N/A N/A | N/A N/A | 3072 |
| 950204 | 103217 103255 | 103232 103270 | AGGGAGCAGAGCATAG | 53 | N/A N/A | N/A N/A | 3073 |
| 950205 | 103219 103257 | 103234 103272 | GGAGGGAGCAGAGCAT | 50 | N/A N/A | N/A N/A | 3074 |
| 950206 | 103221 103259 | 103236 103274 | ATGGAGGGAGCAGAGC | 53 | N/A N/A | N/A N/A | 3075 |
| 950297 | 113289 113606 | 113304 113621 | ATCCTGTTATATCTTT | 3 | N/A N/A | N/A N/A | 3076 |
| 950298 | 113290 113607 | 113305 113622 | AATCCTGTTATATCTT | 2 | N/A N/A | N/A N/A | 3077 |

Each modified oligonucleotide listed in the table below is 100% complementary to human DNM2 nucleic acid sequence GENBANK Number NM_001005361.2. (SEQ ID No: 3 (. As shown below, modified oligonucleotides complementary to human DNM2 inhibited human DNM2 mRNA expression.

TABLE 4

DNM2 mRNA Expression

| Compound Number | SEQ ID: 3 Start Site | SEQ ID: 3 Stop Site | Sequence | Dynamin2 (% Control) | SEQ ID NO |
|---|---|---|---|---|---|
| 948482 | 1735 | 1750 | CACCAGGATCTCCCCC | 30 | 3078 |
| 948483 | 1738 | 1753 | GATCACCAGGATCTCC | 101 | 3079 |
| 948509 | 1511 | 1526 | GCTTCTCGGCACACTT | 27 | 3080 |
| 948510 | 1512 | 1527 | AGCTTCTCGGCACACT | 48 | 3081 |
| 948511 | 1514 | 1529 | TGAGCTTCTCGGCACA | 111 | 3082 |
| 948512 | 1520 | 1535 | AGGAACTGAGCTTCTC | 39 | 3083 |
| 948513 | 1521 | 1536 | TAGGAACTGAGCTTCT | 37 | 3084 |

Example 3: Effect of Modified Oligonucleotides Complementary to Dynamin 2 In Vitro Modified oligonucleotides complementary to dynamin 2 (DNM2) nucleic acid were designed and tested for their effect on dynamin 2 mRNA in vitro. The modified oligonucleotides were tested in a series of experiments that had similar culture conditions.

A431 cells cultured at a density of 10,000 cells per well were treated with only 500 nM of modified oligonucleotide via free uptake or no modified oligonucleotide for untreated controls. After approximately 24 hours, RNA was isolated from the cells and DNM2 mRNA levels were measured by quantitative real-time PCR as described in Example 1.

The modified oligonucleotides described in the tables below each have a 3-10-3 cEt gapmer motif, wherein the central gap segment contains ten 2'-deoxynucleosides and is flanked by wing segments on the 3' and 5' ends, each containing three cEt nucleosides. Each modified oligonucleotide listed in the tables below is 100% complementary to human DNM2 nucleic acid sequence GENBANK Number NC_000019.10, truncated from 10715001 to 1083500 (SEQ ID NO: 1) and/or GENBANK Number NM_004945.3 (SEQ ID NO: 2). As shown below, modified oligonucleotides complementary to human DNM2 inhibited human DNM2 mRNA expression.

TABLE 5

DNM2 mRNA Expression

| Compound Number | SEQ ID: 1 Start Site | SEQ ID: 1 Stop Site | Sequence | DNM2 (% Control) | SEQ ID: 2 Start Site | SEQ ID 2: Stop Site | SEQ ID NO |
|---|---|---|---|---|---|---|---|
| 694824 | 57496 | 57511 | TTTTGGACTTGCAGTG | 25 | 443 | 458 | 3085 |
| 695171 | 82451 | 82466 | ACACACTTCAAACTCG | 30 | N/A | N/A | 13 |

TABLE 5-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 695171 | 82451 | 82466 | ACACACTTCAAACTCG | 26 | N/A | N/A | 13 |
| 695171 | 82451 | 82466 | ACACACTTCAAACTCG | 28 | N/A | N/A | 13 |
| 695171 | 82451 | 82466 | ACACACTTCAAACTCG | 31 | N/A | N/A | 13 |
| 695171 | 82451 | 82466 | ACACACTTCAAACTCG | 27 | N/A | N/A | 13 |
| 695171 | 82451 | 82466 | ACACACTTCAAACTCG | 42 | N/A | N/A | 13 |
| 695171 | 82451 | 82466 | ACACACTTCAAACTCG | 37 | N/A | N/A | 13 |
| 695171 | 82451 | 82466 | ACACACTTCAAACTCG | 29 | N/A | N/A | 13 |
| 951371 | 11922 | 11937 | GTTGATAGTCGGTTGT | 9 | N/A | N/A | 2452 |
| 951371 | 11922 | 11937 | GTTGATAGTCGGTTGT | 8 | N/A | N/A | 2452 |
| 951371 | 11922 | 11937 | GTTGATAGTCGGTTGT | 7 | N/A | N/A | 2452 |
| 951371 | 11922 | 11937 | GTTGATAGTCGGTTGT | 7 | N/A | N/A | 2452 |
| 951371 | 11922 | 11937 | GTTGATAGTCGGTTGT | 7 | N/A | N/A | 2452 |
| 951371 | 11922 | 11937 | GTTGATAGTCGGTTGT | 10 | N/A | N/A | 2452 |
| 951371 | 11922 | 11937 | GTTGATAGTCGGTTGT | 19 | N/A | N/A | 2452 |
| 951371 | 11922 | 11937 | GTTGATAGTCGGTTGT | 9 | N/A | N/A | 2452 |
| 988378 | 82447 | 82462 | ACTTCAAACTCGGCTC | 24 | N/A | N/A | 3086 |
| 988379 | 81166 | 81181 | AACTGTATTGATTAGC | 20 | 1492 | 1507 | 3087 |
| 988380 | 116569 | 116584 | GTGTGGTTAATATGGC | 2 | 3313 | 3328 | 3088 |
| 988381 | 116853 | 116868 | ATAGAATACAGAGTGC | 19 | 3597 | 3612 | 3089 |
| 988382 | 11917 | 11932 | TAGTCGGTTGTCTGGA | 21 | N/A | N/A | 3090 |
| 988383 | 11919 | 11934 | GATAGTCGGTTGTCTG | 37 | N/A | N/A | 3091 |
| 988384 | 11920 | 11935 | TGATAGTCGGTTGTCT | 67 | N/A | N/A | 3092 |
| 988385 | 11921 | 11936 | TTGATAGTCGGTTGTC | 26 | N/A | N/A | 3093 |
| 988386 | 11923 | 11938 | AGTTGATAGTCGGTTG | 3 | N/A | N/A | 3094 |
| 988387 | 11924 | 11939 | GAGTTGATAGTCGGTT | 5 | N/A | N/A | 3095 |
| 988388 | 11925 | 11940 | CGAGTTGATAGTCGGT | 9 | N/A | N/A | 3096 |
| 988389 | 11927 | 11942 | AGCGAGTTGATAGTCG | 42 | N/A | N/A | 3097 |
| 988390 | 24283 | 24298 | GTATTATGGTATGTGA | 14 | N/A | N/A | 3098 |
| 988391 | 24286 | 24301 | TAGGTATTATGGTATG | 20 | N/A | N/A | 3099 |
| 988392 | 24287 | 24302 | TTAGGTATTATGGTAT | 31 | N/A | N/A | 3100 |
| 988393 | 24288 | 24303 | ATTAGGTATTATGGTA | 29 | N/A | N/A | 3101 |
| 988394 | 24290 | 24305 | GGATTAGGTATTATGG | 6 | N/A | N/A | 3102 |
| 988395 | 82040 | 82055 | TTGGACTGTTTTCCCC | 39 | N/A | N/A | 3103 |
| 988396 | 82042 | 82057 | GTTTGGACTGTTTTCC | 7 | N/A | N/A | 3104 |
| 988397 | 82824 | 82839 | GATGTGTTTCCTGTGT | 2 | N/A | N/A | 3105 |
| 988398 | 82825 | 82840 | TGATGTGTTTCCTGTG | 3 | N/A | N/A | 3106 |

TABLE 5-continued

DNM2 mRNA Expression

| Compound Number | SEQ ID: 1 Start Site | SEQ ID: 1 Stop Site | Sequence | DNM2 (% Control) | SEQ ID: 2 Start Site | SEQ ID: 2 Stop Site | SEQ ID NO |
|---|---|---|---|---|---|---|---|
| 988399 | 82826 | 82841 | ATGATGTGTTTCCTGT | 5 | N/A | N/A | 3107 |
| 988400 | 82828 | 82843 | AGATGATGTGTTTCCT | 4 | N/A | N/A | 3108 |
| 988401 | 82829 | 82844 | CAGATGATGTGTTTCC | 4 | N/A | N/A | 3109 |
| 988402 | 82830 | 82845 | ACAGATGATGTGTTTC | 7 | N/A | N/A | 3110 |
| 988403 | 82832 | 82847 | ATACAGATGATGTGTT | 99 | N/A | N/A | 3111 |
| 988404 | 83917 | 83932 | TTTTTGAGAGGTTGAC | 19 | N/A | N/A | 3112 |
| 988405 | 89716 | 89731 | TATAGGGCTTCTTATC | 61 | N/A | N/A | 3113 |
| 988406 | 89717 | 89732 | TTATAGGGCTTCTTAT | 64 | N/A | N/A | 3114 |
| 988407 | 89723 | 89738 | AGTTTATTATAGGGCT | 8 | N/A | N/A | 3115 |
| 988408 | 89724 | 89739 | AAGTTTATTATAGGGC | 13 | N/A | N/A | 3116 |
| 988409 | 89725 | 89740 | TAAGTTTATTATAGGG | 25 | N/A | N/A | 3117 |
| 988410 | 89726 | 89741 | GTAAGTTTATTATAGG | 24 | N/A | N/A | 3118 |
| 988411 | 89727 | 89742 | AGTAAGTTTATTATAG | 96 | N/A | N/A | 3119 |
| 988412 | 90717 | 90732 | ATGTATCTGGTTCAAT | 34 | N/A | N/A | 3120 |
| 988413 | 90718 | 90733 | AATGTATCTGGTTCAA | 11 | N/A | N/A | 3121 |
| 988414 | 90719 | 90734 | AAATGTATCTGGTTCA | 8 | N/A | N/A | 3122 |
| 988415 | 90720 | 90735 | TAAATGTATCTGGTTC | 11 | N/A | N/A | 3123 |
| 988416 | 90723 | 90738 | AAGTAAATGTATCTGG | 15 | N/A | N/A | 3124 |
| 988417 | 90724 | 90739 | CAAGTAAATGTATCTG | 51 | N/A | N/A | 3125 |
| 988418 | 90725 | 90740 | ACAAGTAAATGTATCT | 45 | N/A | N/A | 3126 |
| 988419 | 90726 | 90741 | AACAAGTAAATGTATC | 109 | N/A | N/A | 3127 |
| 988420 | 93918 | 93933 | TTCTGGTCTGGCTTAA | 16 | N/A | N/A | 3128 |
| 988421 | 93920 | 93935 | AATTCTGGTCTGGCTT | 45 | N/A | N/A | 3129 |
| 988422 | 93922 | 93937 | TGAATTCTGGTCTGGC | 7 | N/A | N/A | 3130 |
| 988423 | 93924 | 93939 | AATGAATTCTGGTCTG | 30 | N/A | N/A | 3131 |
| 988424 | 93925 | 93940 | GAATGAATTCTGGTCT | 80 | N/A | N/A | 3132 |
| 988425 | 93926 | 93941 | AGAATGAATTCTGGTC | 20 | N/A | N/A | 3133 |
| 988426 | 93928 | 93943 | CAAGAATGAATTCTGG | 74 | N/A | N/A | 3134 |

Example 4: Dose Response of Modified Oligonucleotides Complementary to Dynamin 2 In Vitro Selected oligonucleotides listed in the Examples above were tested at various doses via free uptake in A431 cells. Cells were cultured at a density of 10,000 cells per well and treated with 62.5, 250, 1,000, or 4,000 nM of modified oligonucleotide, as specified in the table below. After a treatment period of approximately 48 hours, total RNA was isolated and analyzed by RT-PCR with primer probe set RTS36027 (described in Example 1), normalized with ribogreen. As illustrated in the tables below, DNM2 mRNA expression was inhibited in a dose-dependent manner by modified oligonucleotides complementary to DNM2.

TABLE 6

DNM2 mRNA Expression

| Compound Number | DNM2 expression (% control) | | | | $IC_{50}$ (μM) |
|---|---|---|---|---|---|
| | 62.5 nM | 250 nM | 1,000 nM | 4,000 nM | |
| 694838 | 31 | 12 | 5 | 3 | <0.1 |
| 695171 | 74 | 28 | 11 | 4 | 0.1 |
| 695171 | 83 | 33 | 11 | 5 | 0.2 |

TABLE 6-continued

DNM2 mRNA Expression

| Compound Number | DNM2 expression (% control) | | | | IC$_{50}$ (µM) |
|---|---|---|---|---|---|
| | 62.5 nM | 250 nM | 1,000 nM | 4,000 nM | |
| 695171 | 57 | 25 | 7 | 3 | 0.1 |
| 695171 | 59 | 24 | 9 | 4 | 0.1 |
| 695171 | 51 | 17 | 9 | 4 | <0.1 |
| 695171 | 57 | 28 | 10 | 4 | 0.1 |
| 907945 | 38 | 10 | 5 | 3 | <0.1 |
| 907946 | 70 | 36 | 17 | 11 | 0.2 |
| 907947 | 48 | 28 | 9 | 6 | <0.1 |
| 907948 | 51 | 22 | 9 | 5 | <0.1 |
| 907949 | 77 | 43 | 16 | 6 | 0.2 |
| 907966 | 53 | 30 | 15 | 8 | <0.1 |
| 907967 | 32 | 10 | 6 | 4 | <0.1 |
| 907968 | 65 | 30 | 14 | 8 | 0.1 |
| 907969 | 19 | 6 | 3 | 2 | <0.1 |
| 907970 | 20 | 5 | 3 | 2 | <0.1 |
| 907971 | 59 | 30 | 17 | 12 | 0.1 |
| 907972 | 72 | 36 | 18 | 17 | 0.2 |
| 907975 | 35 | 15 | 7 | 4 | <0.1 |
| 907979 | 55 | 26 | 14 | 10 | <0.1 |
| 907983 | 39 | 16 | 9 | 8 | <0.1 |
| 907998 | 40 | 13 | 6 | 4 | <0.1 |
| 908000 | 71 | 42 | 19 | 11 | 0.2 |
| 908011 | 53 | 24 | 13 | 9 | <0.1 |
| 908013 | 52 | 25 | 13 | 7 | <0.1 |
| 908025 | 69 | 31 | 13 | 6 | 0.1 |
| 908027 | 38 | 13 | 5 | 2 | <0.1 |
| 908028 | 80 | 51 | 22 | 9 | 0.3 |
| 908029 | 83 | 43 | 19 | 9 | 0.3 |
| 908031 | 44 | 13 | 4 | 2 | <0.1 |
| 908033 | 52 | 18 | 8 | 5 | <0.1 |
| 908034 | 63 | 29 | 13 | 8 | 0.1 |
| 908035 | 26 | 6 | 2 | 1 | <0.1 |
| 908036 | 71 | 39 | 20 | 11 | 0.2 |
| 908037 | 26 | 9 | 3 | 1 | <0.1 |
| 908041 | 49 | 19 | 6 | 3 | <0.1 |
| 908043 | 28 | 15 | 10 | 8 | <0.1 |
| 908044 | 43 | 17 | 7 | 3 | <0.1 |
| 908047 | 54 | 28 | 15 | 9 | <0.1 |
| 908049 | 49 | 15 | 6 | 3 | <0.1 |
| 908052 | 53 | 21 | 7 | 4 | <0.1 |
| 908055 | 69 | 36 | 19 | 12 | 0.2 |
| 908056 | 54 | 23 | 9 | 6 | <0.1 |
| 908059 | 35 | 11 | 3 | 2 | <0.1 |
| 908061 | 27 | 7 | 2 | 1 | <0.1 |
| 908068 | 72 | 41 | 21 | 10 | 0.2 |
| 908070 | 64 | 35 | 15 | 9 | 0.1 |
| 908085 | 68 | 33 | 18 | 11 | 0.1 |
| 908098 | 61 | 28 | 12 | 10 | 0.1 |
| 908102 | 42 | 28 | 17 | 11 | <0.1 |
| 908104 | 44 | 23 | 12 | 8 | <0.1 |
| 908107 | 51 | 25 | 11 | 7 | <0.1 |
| 908135 | 46 | 23 | 14 | 14 | <0.1 |
| 908138 | 50 | 24 | 11 | 6 | <0.1 |
| 908146 | 58 | 33 | 19 | 15 | 0.1 |
| 908147 | 37 | 18 | 10 | 6 | <0.1 |
| 908148 | 42 | 15 | 7 | 5 | <0.1 |
| 908154 | 28 | 9 | 3 | 2 | <0.1 |
| 908164 | 65 | 31 | 16 | 10 | 0.1 |
| 908166 | 44 | 18 | 9 | 5 | <0.1 |
| 908167 | 62 | 28 | 16 | 12 | 0.1 |
| 908177 | 69 | 37 | 15 | 7 | 0.2 |
| 908178 | 52 | 22 | 6 | 4 | <0.1 |
| 908179 | 47 | 18 | 7 | 4 | <0.1 |
| 908183 | 58 | 34 | 15 | 11 | 0.1 |
| 908184 | 56 | 24 | 11 | 8 | <0.1 |
| 908201 | 26 | 13 | 5 | 4 | <0.1 |
| 908213 | 37 | 13 | 5 | 3 | <0.1 |
| 908214 | 57 | 37 | 17 | 12 | 0.1 |
| 908215 | 63 | 30 | 12 | 6 | 0.1 |
| 908217 | 32 | 10 | 3 | 2 | <0.1 |
| 908232 | 58 | 26 | 6 | 3 | 0.1 |
| 908255 | 64 | 28 | 13 | 9 | 0.1 |
| 908267 | 48 | 28 | 12 | 8 | 0.1 |
| 908355 | 83 | 62 | 42 | 26 | 0.6 |
| 908389 | 43 | 16 | 5 | 3 | <0.1 |
| 908392 | 12 | 3 | 1 | 1 | <0.1 |
| 908396 | 57 | 19 | 6 | 3 | <0.1 |
| 908401 | 26 | 6 | 2 | 1 | <0.1 |
| 908404 | 58 | 29 | 15 | 8 | 0.1 |
| 908405 | 49 | 26 | 9 | 4 | <0.1 |
| 908407 | 70 | 30 | 12 | 5 | 0.1 |
| 908408 | 18 | 2 | 1 | 1 | <0.1 |
| 908409 | 67 | 33 | 13 | 5 | 0.1 |
| 908410 | 71 | 36 | 15 | 7 | 0.2 |
| 908412 | 58 | 24 | 10 | 6 | 0.1 |
| 908413 | 33 | 8 | 2 | 1 | <0.1 |
| 908414 | 25 | 6 | 3 | 2 | <0.1 |
| 908415 | 40 | 11 | 4 | 3 | <0.1 |
| 908416 | 42 | 13 | 4 | 1 | <0.1 |
| 908417 | 26 | 5 | 2 | 1 | <0.1 |
| 908418 | 63 | 33 | 11 | 4 | 0.1 |
| 908419 | 50 | 11 | 4 | 2 | <0.1 |
| 908420 | 17 | 3 | 1 | 1 | <0.1 |
| 908421 | 23 | 4 | 1 | 1 | <0.1 |
| 908422 | 51 | 16 | 5 | 3 | <0.1 |
| 908424 | 57 | 22 | 9 | 7 | <0.1 |
| 908425 | 57 | 38 | 20 | 12 | 0.1 |
| 908434 | 54 | 20 | 8 | 3 | <0.1 |
| 908436 | 71 | 40 | 17 | 8 | 0.2 |
| 908439 | 38 | 9 | 2 | 2 | <0.1 |
| 908440 | 25 | 6 | 3 | 3 | <0.1 |
| 908441 | 33 | 6 | 2 | 1 | <0.1 |
| 908442 | 32 | 9 | 3 | 1 | <0.1 |
| 908443 | 56 | 17 | 5 | 2 | <0.1 |
| 908444 | 31 | 7 | 2 | 1 | <0.1 |
| 908448 | 78 | 44 | 13 | 8 | 0.2 |
| 908449 | 47 | 20 | 7 | 4 | <0.1 |
| 908451 | 45 | 14 | 6 | 5 | <0.1 |
| 908475 | 66 | 29 | 12 | 5 | 0.1 |
| 908506 | 34 | 9 | 4 | 3 | <0.1 |
| 908507 | 67 | 39 | 16 | 10 | 0.1 |
| 908508 | 52 | 30 | 14 | 10 | <0.1 |

Example 5: Dose Response of Modified Oligonucleotides Complementary to Dynamin 2 In Vitro Selected oligonucleotides listed in the Examples above were tested via free uptake at various doses in A431 cells. Cells were cultured at a density of 10,000 cells per well and treated with 31.25, 125, 500, or 2,000 nM of modified oligonucleotide, as specified in the tables below. After approximately 48 hours, total RNA was isolated and analyzed by RT-PCR with primer probe set RTS36027 (described in Example 1), normalized with ribogreen. As illustrated in the tables below, DNM2 mRNA expression was inhibited in a dose-dependent manner by modified oligonucleotides complementary to DNM2.

TABLE 7

DNM2 mRNA Expression

| Compound Number | DNM2 expression (% control) | | | | IC50 (µM) |
|---|---|---|---|---|---|
| | 31.25 nM | 125 nM | 500 nM | 2,000 nM | |
| 695015 | 105 | 94 | 89 | 94 | >2.0 |
| 695170 | 62 | 30 | 13 | 5 | 0.05 |
| 695171 | 72 | 33 | 11 | 4 | 0.07 |
| 695171 | 70 | 33 | 10 | 3 | 0.1 |
| 695171 | 70 | 35 | 14 | 6 | 0.1 |
| 695171 | 58 | 22 | 9 | 2 | <0.03 |

TABLE 7-continued

DNM2 mRNA Expression

| Compound Number | DNM2 expression (% control) | | | | IC50 (μM) |
|---|---|---|---|---|---|
| | 31.25 nM | 125 nM | 500 nM | 2,000 nM | |
| 695171 | 71 | 36 | 12 | 4 | 0.08 |
| 695171 | 70 | 32 | 11 | 4 | 0.07 |
| 695171 | 74 | 36 | 12 | 4 | 0.08 |
| 695171 | 71 | 31 | 10 | 3 | 0.07 |
| 695171 | 73 | 36 | 14 | 4 | 0.08 |
| 695171 | 73 | 36 | 17 | 7 | 0.09 |
| 695171 | 54 | 27 | 10 | 3 | <0.03 |
| 695171 | 69 | 33 | 10 | 5 | 0.06 |
| 695171 | 74 | 35 | 12 | 4 | 0.08 |
| 695171 | 81 | 40 | 14 | 4 | 0.11 |
| 695171 | 79 | 40 | 14 | 5 | 0.11 |
| 695171 | 77 | 38 | 14 | 5 | 0.10 |
| 695171 | 72 | 37 | 13 | 5 | 0.08 |
| 695171 | 71 | 34 | 11 | 4 | 0.07 |
| 695171 | 66 | 43 | 11 | 5 | 0.08 |
| 695171 | 68 | 33 | 11 | 4 | 0.06 |
| 695171 | 63 | 29 | 12 | 5 | 0.05 |
| 948488 | 79 | 33 | 12 | 4 | 0.09 |
| 948489 | 53 | 17 | 5 | 1 | <0.03 |
| 948490 | 25 | 5 | 1 | 0 | <0.03 |
| 948492 | 67 | 32 | 9 | 4 | 0.06 |
| 948496 | 72 | 43 | 15 | 6 | 0.09 |
| 948505 | 67 | 36 | 12 | 5 | 0.07 |
| 948506 | 58 | 16 | 5 | 2 | <0.03 |
| 948507 | 80 | 30 | 9 | 3 | 0.1 |
| 948508 | 63 | 26 | 7 | 3 | 0.0 |
| 948521 | 79 | 35 | 19 | 13 | 0.11 |
| 948524 | 70 | 43 | 19 | 9 | 0.09 |
| 948525 | 75 | 47 | 19 | 7 | 0.12 |
| 948526 | 73 | 35 | 12 | 7 | 0.08 |
| 948527 | 62 | 31 | 14 | 9 | 0.05 |
| 948528 | 64 | 29 | 11 | 20 | 0.04 |
| 948538 | 104 | 95 | 96 | 91 | >2.0 |
| 948549 | 71 | 38 | 16 | 11 | 0.08 |
| 948556 | 36 | 11 | 4 | 3 | <0.03 |
| 948557 | 23 | 8 | 4 | 3 | <0.03 |
| 948558 | 68 | 29 | 14 | 10 | 0.06 |
| 948559 | 48 | 16 | 7 | 5 | <0.03 |
| 948560 | 24 | 7 | 3 | 2 | <0.03 |
| 948562 | 69 | 26 | 10 | 5 | 0.06 |
| 948568 | 57 | 26 | 11 | 7 | <0.03 |
| 948575 | 73 | 39 | 20 | 10 | 0.1 |
| 948587 | 43 | 14 | 7 | 4 | <0.03 |
| 948589 | 66 | 21 | 11 | 9 | 0.04 |
| 948590 | 53 | 35 | 16 | 10 | 0.03 |
| 948602 | 39 | 15 | 7 | 5 | <0.03 |
| 948604 | 42 | 17 | 7 | 4 | <0.03 |
| 948608 | 54 | 18 | 6 | 4 | <0.03 |
| 948622 | 79 | 47 | 22 | 10 | 0.13 |
| 948629 | 51 | 13 | 6 | 2 | <0.03 |
| 948630 | 67 | 33 | 13 | 5 | 0.06 |
| 948631 | 46 | 14 | 5 | 3 | <0.03 |
| 948632 | 42 | 12 | 5 | 2 | <0.03 |
| 948633 | 57 | 21 | 8 | 6 | <0.03 |
| 948646 | 63 | 58 | 23 | 10 | 0.11 |
| 948654 | 68 | 40 | 13 | 4 | 0.08 |
| 948656 | 69 | 40 | 22 | 13 | 0.09 |
| 948660 | 47 | 11 | 2 | 1 | <0.03 |
| 948661 | 80 | 41 | 14 | 4 | 0.11 |
| 948662 | 63 | 38 | 16 | 8 | 0.06 |
| 948664 | 45 | 12 | 2 | 1 | <0.03 |
| 948665 | 64 | 25 | 7 | 3 | 0.04 |
| 948666 | 82 | 37 | 12 | 4 | 0.11 |
| 948673 | 33 | 9 | 3 | 2 | <0.03 |
| 948674 | 75 | 39 | 12 | 5 | 0.1 |
| 948675 | 43 | 8 | 2 | 0 | <0.03 |
| 948676 | 40 | 10 | 2 | 0 | <0.03 |
| 948677 | 53 | 11 | 2 | 1 | <0.03 |
| 948678 | 69 | 27 | 9 | 4 | 0.06 |
| 948684 | 61 | 29 | 11 | 4 | 0.04 |
| 948685 | 52 | 15 | 5 | 2 | <0.03 |
| 948686 | 24 | 8 | 2 | 1 | <0.03 |
| 948687 | 58 | 19 | 5 | 2 | <0.03 |
| 948689 | 73 | 26 | 17 | 8 | 0.07 |
| 948692 | 49 | 20 | 8 | 6 | <0.03 |
| 948693 | 71 | 40 | 18 | 10 | 0.09 |
| 948695 | 75 | 38 | 20 | 7 | 0.1 |
| 948700 | 63 | 25 | 7 | 3 | 0.04 |
| 948701 | 64 | 24 | 9 | 4 | 0.04 |
| 948702 | 60 | 25 | 6 | 1 | 0.04 |
| 948703 | 66 | 29 | 7 | 2 | 0.05 |
| 948707 | 69 | 24 | 7 | 3 | 0.05 |
| 948729 | 47 | 12 | 2 | 1 | <0.03 |
| 948731 | 67 | 33 | 11 | 4 | 0.06 |
| 948732 | 68 | 40 | 14 | 7 | 0.08 |
| 948735 | 22 | 9 | 2 | 2 | <0.03 |
| 948741 | 49 | 55 | 24 | 15 | 0.06 |
| 948752 | 64 | 31 | 12 | 5 | 0.05 |
| 948765 | 61 | 20 | 7 | 3 | 0.03 |
| 948766 | 78 | 43 | 18 | 7 | 0.11 |
| 948767 | 76 | 40 | 19 | 12 | 0.1 |
| 948768 | 67 | 35 | 17 | 12 | 0.1 |
| 948769 | 60 | 24 | 10 | 5 | 0.0 |
| 948788 | 57 | 27 | 13 | 10 | 0.03 |
| 948794 | 51 | 26 | 5 | 2 | <0.03 |
| 948804 | 42 | 18 | 8 | 5 | <0.03 |
| 948805 | 34 | 13 | 5 | 3 | <0.03 |
| 948806 | 16 | 18 | 7 | 5 | <0.03 |
| 948807 | 56 | 35 | 18 | 11 | 0.04 |
| 948812 | 77 | 40 | 20 | 11 | 0.11 |
| 948835 | 66 | 28 | 7 | 3 | 0.05 |
| 948836 | 52 | 27 | 11 | 6 | <0.03 |
| 948847 | 68 | 32 | 12 | 7 | 0.06 |
| 948849 | 43 | 13 | 6 | 5 | <0.03 |
| 948850 | 43 | 15 | 7 | 5 | <0.03 |
| 948851 | 45 | 16 | 5 | 3 | <0.03 |
| 948852 | 51 | 16 | 4 | 2 | <0.03 |
| 948853 | 84 | 32 | 9 | 5 | 0.10 |
| 948854 | 58 | 21 | 7 | 3 | <0.03 |
| 948855 | 56 | 30 | 12 | 6 | 0.03 |
| 948856 | 70 | 38 | 14 | 8 | 0.08 |
| 948862 | 55 | 26 | 10 | 4 | <0.03 |
| 948863 | 43 | 8 | 2 | 2 | <0.03 |
| 948865 | 57 | 24 | 10 | 6 | <0.03 |
| 948880 | 84 | 46 | 26 | 14 | 0.16 |
| 948882 | 66 | 36 | 19 | 8 | 0.07 |
| 948883 | 81 | 62 | 29 | 16 | 0.21 |
| 948884 | 59 | 25 | 9 | 4 | 0.03 |
| 948885 | 53 | 18 | 6 | 4 | <0.03 |
| 948891 | 96 | 52 | 24 | 12 | 0.20 |
| 948892 | 54 | 24 | 7 | 4 | <0.03 |
| 948893 | 93 | 84 | 59 | 44 | 1.24 |
| 948906 | 81 | 46 | 19 | 9 | 0.13 |
| 948907 | 65 | 25 | 8 | 4 | 0.05 |
| 948910 | 62 | 22 | 8 | 4 | 0.0 |
| 948911 | 48 | 16 | 10 | 4 | <0.03 |
| 948917 | 81 | 57 | 30 | 19 | 0.20 |
| 948918 | 69 | 36 | 14 | 6 | 0.07 |
| 948922 | 64 | 32 | 12 | 6 | 0.05 |
| 948923 | 30 | 8 | 4 | 3 | <0.03 |
| 948924 | 32 | 11 | 3 | 2 | <0.03 |
| 948925 | 58 | 27 | 9 | 6 | 0.03 |
| 948926 | 109 | 94 | 105 | 111 | >2.0 |
| 948935 | 38 | 17 | 6 | 3 | <0.03 |
| 948936 | 47 | 12 | 4 | 2 | <0.03 |
| 948937 | 48 | 21 | 7 | 3 | <0.03 |
| 948938 | 49 | 19 | 8 | 5 | <0.03 |
| 948950 | 54 | 27 | 8 | 3 | <0.03 |
| 948951 | 32 | 13 | 5 | 3 | <0.03 |
| 948952 | 46 | 13 | 4 | 2 | <0.03 |
| 948953 | 69 | 41 | 14 | 7 | 0.08 |
| 948954 | 43 | 15 | 8 | 4 | <0.03 |
| 948960 | 41 | 14 | 8 | 7 | <0.03 |
| 948961 | 48 | 17 | 6 | 3 | <0.03 |
| 948963 | 51 | 23 | 8 | 4 | <0.03 |
| 948965 | 96 | 77 | 53 | 28 | 0.57 |
| 948966 | 63 | 32 | 11 | 4 | 0.05 |
| 948967 | 71 | 38 | 13 | 6 | 0.08 |

TABLE 7-continued

DNM2 mRNA Expression

| Compound Number | DNM2 expression (% control) | | | | IC50 (µM) |
|---|---|---|---|---|---|
| | 31.25 nM | 125 nM | 500 nM | 2,000 nM | |
| 948968 | 60 | 29 | 9 | 3 | 0.04 |
| 948969 | 47 | 18 | 6 | 4 | <0.03 |
| 948970 | 31 | 9 | 3 | 2 | <0.03 |
| 948971 | 34 | 9 | 2 | 2 | <0.03 |
| 948972 | 72 | 32 | 9 | 3 | 0.07 |
| 949006 | 79 | 53 | 19 | 8 | 0.1 |
| 949007 | 84 | 37 | 9 | 6 | 0.1 |
| 949012 | 81 | 38 | 17 | 10 | 0.11 |
| 949040 | 80 | 36 | 11 | 4 | 0.10 |
| 949041 | 101 | 50 | 14 | 5 | 0.18 |
| 949051 | 74 | 45 | 16 | 8 | 0.10 |
| 949053 | 89 | 54 | 18 | 5 | 0.2 |
| 949055 | 68 | 24 | 8 | 4 | 0.0 |
| 949059 | 73 | 40 | 15 | 5 | 0.09 |
| 949061 | 109 | 99 | 83 | 73 | >2.0 |
| 949077 | 82 | 47 | 15 | 5 | 0.1 |
| 949080 | 48 | 20 | 7 | 5 | <0.03 |
| 949088 | 73 | 24 | 8 | 3 | 0.06 |
| 949092 | 66 | 24 | 13 | 14 | 0.05 |
| 949094 | 79 | 48 | 17 | 6 | 0.13 |
| 949095 | 90 | 66 | 19 | 6 | 0.20 |
| 949109 | 95 | 55 | 26 | 13 | 0.22 |
| 949139 | 72 | 47 | 24 | 11 | 0.12 |
| 949158 | 54 | 20 | 10 | 8 | <0.03 |
| 949159 | 75 | 40 | 15 | 25 | 0.10 |
| 949163 | 52 | 15 | 4 | 2 | <0.03 |
| 949164 | 42 | 30 | 15 | 10 | <0.03 |
| 949167 | 78 | 39 | 17 | 21 | 0.11 |
| 949168 | 67 | 36 | 19 | 12 | 0.07 |
| 949182 | 65 | 27 | 8 | 4 | 0.05 |
| 949190 | 57 | 15 | 3 | 2 | <0.03 |
| 949216 | 74 | 42 | 14 | 5 | 0.10 |
| 949223 | 87 | 28 | 16 | 6 | 0.1 |
| 949229 | 125 | 101 | 92 | 78 | >2.0 |
| 949279 | 85 | 41 | 15 | 5 | 0.12 |
| 949325 | 98 | 112 | 86 | 75 | >2.0 |
| 949397 | 94 | 96 | 100 | 106 | >2.0 |
| 949483 | 71 | 43 | 21 | 11 | 0.10 |
| 949500 | 78 | 56 | 24 | 10 | 0.16 |
| 949517 | 103 | 98 | 97 | 80 | >2.0 |
| 949589 | 111 | 89 | 57 | 42 | 1.06 |
| 949685 | 101 | 82 | 58 | 40 | 0.99 |
| 949778 | 90 | 55 | 20 | 9 | 0.18 |
| 949805 | 106 | 88 | 66 | 48 | 1.73 |
| 949814 | 59 | 51 | 22 | 8 | 0.08 |
| 949841 | 87 | 46 | 11 | 4 | 0.13 |
| 949846 | 48 | 30 | 11 | 7 | <0.03 |
| 949848 | 57 | 18 | 4 | 2 | <0.03 |
| 949858 | 66 | 23 | 10 | 6 | 0.04 |
| 949865 | 61 | 11 | 3 | 1 | <0.03 |
| 949871 | 70 | 26 | 7 | 3 | 0.1 |
| 949872 | 47 | 13 | 3 | 1 | <0.03 |
| 949873 | 45 | 10 | 2 | 1 | <0.03 |
| 949874 | 14 | 3 | 1 | 0 | <0.03 |
| 949875 | 54 | 23 | 5 | 2 | <0.03 |
| 949876 | 79 | 32 | 10 | 5 | 0.09 |
| 949880 | 52 | 20 | 6 | 3 | <0.03 |
| 949884 | 87 | 41 | 16 | 7 | 0.13 |
| 949886 | 62 | 22 | 6 | 3 | 0.04 |
| 949887 | 87 | 64 | 21 | 8 | 0.19 |
| 949892 | 83 | 49 | 22 | 13 | 0.2 |
| 949896 | 13 | 1 | 1 | 0 | <0.03 |
| 949897 | 67 | 32 | 15 | 7 | 0.06 |
| 949899 | 80 | 49 | 20 | 6 | 0.14 |
| 949917 | 80 | 48 | 22 | 10 | 0.1 |
| 949918 | 84 | 46 | 15 | 4 | 0.1 |
| 949920 | 59 | 20 | 3 | 2 | <0.03 |
| 949921 | 67 | 19 | 2 | 1 | 0.04 |
| 949922 | 56 | 21 | 6 | 2 | <0.03 |
| 949923 | 70 | 34 | 15 | 7 | 0.07 |
| 949924 | 112 | 106 | 5 | 2 | 0.31 |
| 949925 | 59 | 27 | 6 | 2 | 0.04 |
| 949926 | 44 | 7 | 1 | 1 | <0.03 |
| 949927 | 37 | 4 | 1 | 1 | <0.03 |
| 949928 | 68 | 20 | 4 | 2 | 0.04 |
| 949929 | 66 | 18 | 3 | 1 | 0.04 |
| 949930 | 61 | 30 | 10 | 4 | 0.04 |
| 949931 | 68 | 27 | 6 | 2 | 0.05 |
| 949932 | 72 | 31 | 6 | 2 | 0.07 |
| 949934 | 66 | 42 | 22 | 12 | 0.08 |
| 949935 | 52 | 20 | 8 | 6 | <0.03 |
| 949937 | 69 | 27 | 7 | 5 | 0.06 |
| 949938 | 66 | 35 | 14 | 5 | 0.06 |
| 949942 | 69 | 30 | 8 | 3 | 0.06 |
| 949943 | 52 | 21 | 6 | 2 | <0.03 |
| 949944 | 60 | 20 | 4 | 3 | 0.03 |
| 949945 | 54 | 16 | 5 | 3 | <0.03 |
| 949948 | 34 | 5 | 1 | 1 | <0.03 |
| 949949 | 46 | 10 | 2 | 1 | <0.03 |
| 949950 | 46 | 12 | 3 | 2 | <0.03 |
| 949962 | 70 | 34 | 16 | 9 | 0.1 |
| 949963 | 71 | 43 | 15 | 6 | 0.1 |
| 949978 | 65 | 35 | 9 | 2 | 0.06 |
| 949979 | 72 | 35 | 11 | 5 | 0.08 |
| 949983 | 89 | 66 | 25 | 12 | 0.23 |
| 949990 | 61 | 23 | 5 | 2 | 0.04 |
| 949991 | 55 | 21 | 5 | 1 | <0.03 |
| 949992 | 56 | 29 | 11 | 6 | 0.03 |
| 950014 | 60 | 28 | 8 | 3 | 0.04 |
| 950017 | 68 | 38 | 11 | 5 | 0.07 |
| 950019 | 52 | 20 | 8 | 5 | <0.03 |
| 950020 | 84 | 43 | 13 | 5 | 0.12 |
| 950021 | 80 | 46 | 15 | 6 | 0.12 |
| 950023 | 57 | 17 | 5 | 2 | <0.03 |
| 950024 | 51 | 17 | 7 | 5 | <0.03 |
| 950030 | 37 | 7 | 1 | 0 | <0.03 |
| 950048 | 57 | 40 | 16 | 6 | 0.05 |
| 950057 | 65 | 38 | 21 | 9 | 0.07 |
| 950060 | 26 | 16 | 3 | 2 | <0.03 |
| 950061 | 55 | 34 | 10 | 5 | 0.04 |
| 950064 | 74 | 32 | 11 | 4 | 0.08 |
| 950065 | 72 | 30 | 8 | 2 | 0.07 |
| 950069 | 68 | 31 | 8 | 4 | 0.06 |
| 950072 | 49 | 20 | 6 | 3 | <0.03 |
| 950075 | 87 | 38 | 13 | 5 | 0.12 |
| 950080 | 69 | 40 | 15 | 7 | 0.08 |
| 950081 | 60 | 28 | 8 | 4 | 0.04 |
| 950083 | 65 | 29 | 12 | 4 | 0.1 |
| 950085 | 53 | 14 | 6 | 4 | <0.03 |
| 950086 | 76 | 43 | 15 | 4 | 0.10 |
| 950089 | 46 | 10 | 2 | 1 | <0.03 |
| 950091 | 45 | 12 | 2 | 1 | <0.03 |
| 950092 | 80 | 42 | 14 | 8 | 0.11 |
| 950102 | 81 | 37 | 9 | 3 | 0.10 |
| 950124 | 69 | 31 | 14 | 8 | 0.06 |
| 950132 | 55 | 14 | 4 | 1 | <0.03 |
| 950139 | 87 | 59 | 24 | 9 | 0.19 |
| 950183 | 44 | 23 | 5 | 2 | <0.03 |
| 950219 | 84 | 37 | 18 | 11 | 0.12 |
| 950237 | 83 | 48 | 17 | 8 | 0.14 |
| 950246 | 76 | 33 | 15 | 7 | 0.09 |
| 951328 | 76 | 37 | 12 | 4 | 0.09 |
| 951330 | 76 | 40 | 13 | 5 | 0.10 |
| 951333 | 89 | 45 | 22 | 9 | 0.16 |
| 951340 | 74 | 42 | 15 | 6 | 0.10 |
| 951341 | 92 | 58 | 21 | 4 | 0.19 |
| 951346 | 49 | 22 | 4 | 3 | <0.03 |
| 951352 | 67 | 19 | 7 | 3 | 0.04 |
| 951354 | 67 | 36 | 12 | 6 | 0.07 |
| 951356 | 57 | 23 | 6 | 2 | <0.03 |
| 951357 | 62 | 35 | 10 | 4 | 0.05 |
| 951358 | 76 | 36 | 12 | 5 | 0.09 |
| 951362 | 53 | 15 | 3 | 1 | <0.03 |
| 951364 | 58 | 18 | 4 | 2 | <0.03 |
| 951365 | 78 | 47 | 16 | 6 | 0.12 |
| 951366 | 61 | 34 | 12 | 6 | 0.05 |
| 951367 | 69 | 28 | 8 | 4 | 0.06 |
| 951370 | 74 | 41 | 16 | 7 | 0.10 |

TABLE 7-continued

DNM2 mRNA Expression

| Compound Number | DNM2 expression (% control) | | | | IC50 (µM) |
|---|---|---|---|---|---|
| | 31.25 nM | 125 nM | 500 nM | 2,000 nM | |
| 951371 | 30 | 7 | 2 | 2 | <0.03 |
| 951372 | 61 | 21 | 6 | 4 | 0.03 |
| 951374 | 62 | 17 | 4 | 2 | 0.03 |
| 951376 | 67 | 47 | 15 | 5 | 0.09 |
| 951381 | 63 | 28 | 11 | 6 | 0.05 |
| 951384 | 63 | 27 | 6 | 2 | 0.05 |
| 951386 | 66 | 22 | 6 | 3 | 0.04 |
| 951387 | 68 | 20 | 3 | 1 | 0.04 |
| 951397 | 69 | 35 | 8 | 4 | 0.07 |
| 951406 | 73 | 52 | 19 | 9 | 0.12 |
| 951407 | 56 | 21 | 6 | 3 | <0.03 |
| 951408 | 47 | 15 | 3 | 1 | <0.03 |
| 951413 | 68 | 46 | 20 | 9 | 0.09 |
| 951416 | 63 | 42 | 17 | 7 | 0.07 |
| 951418 | 60 | 22 | 6 | 3 | 0.03 |
| 951428 | 28 | 4 | 1 | 1 | <0.03 |
| 951429 | 32 | 6 | 2 | 2 | <0.03 |
| 951430 | 59 | 25 | 6 | 2 | 0.03 |
| 951431 | 46 | 32 | 9 | 5 | <0.03 |
| 951441 | 100 | 82 | 67 | 42 | 1.33 |
| 951450 | 71 | 36 | 12 | 6 | 0.08 |
| 951458 | 63 | 32 | 15 | 10 | 0.05 |
| 951459 | 77 | 44 | 17 | 9 | 0.11 |
| 951462 | 74 | 28 | 6 | 2 | 0.07 |
| 951463 | 74 | 35 | 15 | 6 | 0.09 |
| 951481 | 91 | 47 | 26 | 13 | 0.18 |
| 951489 | 59 | 17 | 8 | 3 | <0.03 |
| 951494 | 64 | 32 | 10 | 5 | 0.05 |
| 951498 | 58 | 27 | 10 | 7 | 0.03 |
| 951519 | 60 | 32 | 8 | 3 | 0.05 |
| 951529 | 90 | 35 | 24 | 18 | 0.15 |
| 951537 | 103 | 101 | 105 | 168 | >2.0 |
| 951550 | 66 | 42 | 15 | 6 | 0.08 |
| 951554 | 83 | 36 | 10 | 5 | 0.10 |
| 951561 | 88 | 59 | 74 | 100 | >2.0 |
| 951565 | 65 | 38 | 13 | 4 | 0.07 |
| 951566 | 77 | 36 | 9 | 3 | 0.09 |
| 951608 | 73 | 25 | 8 | 4 | 0.06 |
| 951645 | 64 | 29 | 12 | 7 | 0.05 |
| 951657 | 107 | 91 | 64 | 62 | >2.0 |
| 951691 | 58 | 28 | 9 | 3 | 0.04 |
| 951696 | 58 | 19 | 9 | 5 | <0.03 |
| 951700 | 76 | 40 | 16 | 9 | 0.10 |
| 951709 | 52 | 25 | 9 | 6 | <0.03 |
| 951729 | 73 | 74 | 88 | 89 | >2.0 |
| 951731 | 70 | 34 | 10 | 4 | 0.07 |
| 951737 | 57 | 24 | 5 | 4 | <0.03 |
| 951746 | 68 | 31 | 17 | 11 | 0.06 |
| 951749 | 71 | 27 | 4 | 2 | 0.06 |
| 951763 | 44 | 11 | 4 | 2 | <0.03 |
| 951764 | 40 | 9 | 2 | 1 | <0.03 |
| 951767 | 87 | 48 | 16 | 5 | 0.14 |
| 951772 | 62 | 30 | 10 | 7 | 0.05 |
| 951781 | 95 | 42 | 15 | 7 | 0.15 |
| 951783 | 56 | 31 | 12 | 5 | 0.04 |
| 951787 | 53 | 20 | 7 | 4 | <0.03 |
| 951793 | 44 | 11 | 4 | 2 | <0.03 |
| 951795 | 64 | 24 | 7 | 3 | 0.04 |
| 951797 | 40 | 15 | 6 | 4 | <0.03 |
| 951798 | 31 | 5 | 1 | 1 | <0.03 |
| 951799 | 27 | 5 | 1 | 1 | <0.03 |
| 951803 | 67 | 29 | 9 | 4 | 0.06 |
| 951804 | 45 | 13 | 3 | 1 | <0.03 |
| 951806 | 65 | 43 | 15 | 7 | 0.07 |
| 951807 | 59 | 30 | 10 | 4 | 0.04 |
| 951808 | 69 | 46 | 18 | 6 | 0.10 |
| 951809 | 47 | 13 | 3 | 1 | <0.03 |
| 951811 | 57 | 22 | 7 | 3 | <0.03 |
| 951814 | 60 | 25 | 10 | 7 | 0.04 |
| 951815 | 58 | 37 | 15 | 7 | 0.05 |
| 951816 | 46 | 10 | 2 | 1 | <0.03 |
| 951821 | 41 | 14 | 4 | 2 | <0.03 |
| 951822 | 86 | 44 | 15 | 7 | 0.13 |
| 951824 | 67 | 23 | 5 | 3 | 0.05 |
| 951827 | 51 | 17 | 5 | 2 | <0.03 |
| 951828 | 63 | 23 | 9 | 4 | 0.04 |
| 951830 | 61 | 26 | 10 | 5 | 0.04 |
| 951833 | 59 | 39 | 9 | 4 | 0.05 |
| 951835 | 23 | 4 | 1 | 0 | <0.03 |
| 951837 | 53 | 16 | 4 | 1 | <0.03 |
| 951838 | 80 | 51 | 22 | 8 | 0.14 |
| 951839 | 56 | 25 | 8 | 2 | <0.03 |
| 951840 | 76 | 37 | 12 | 4 | 0.09 |
| 951841 | 69 | 27 | 11 | 2 | 0.06 |
| 951843 | 63 | 29 | 8 | 4 | 0.05 |
| 951845 | 39 | 9 | 3 | 1 | <0.03 |
| 951846 | 45 | 14 | 3 | 1 | <0.03 |
| 951855 | 87 | 65 | 19 | 5 | 0.19 |
| 951856 | 61 | 18 | 4 | 2 | <0.03 |
| 951857 | 57 | 27 | 7 | 2 | 0.03 |
| 951874 | 74 | 73 | 68 | 47 | >2.0 |
| 951875 | 66 | 33 | 10 | 4 | 0.06 |
| 951881 | 49 | 22 | 3 | 2 | <0.03 |
| 951893 | 53 | 26 | 10 | 5 | <0.03 |
| 951898 | 46 | 18 | 5 | 2 | <0.03 |
| 951902 | 61 | 34 | 13 | 7 | 0.05 |
| 951938 | 85 | 51 | 20 | 11 | 0.16 |

Example 6: Dose Response of Modified Oligonucleotides Complementary to Dynamin 2 In Vitro Selected oligonucleotides listed in the Examples above were tested at various doses via free uptake in A431 cells. Cells were cultured at a density of 10,000 cells per well and treated with 8, 40, 200, or 1,000 nM of modified oligonucleotide, as specified in the table below. After approximately 48 hours, total RNA was isolated and analyzed by RT-PCR with primer probe set RTS36027 (described in Example 1), normalized with GADPH. As illustrated in the tables below, DNM2 mRNA expression was inhibited in a dose-dependent manner by modified oligonucleotides complementary to DNM2.

TABLE 8

DNM2 mRNA Expression

| Compound Number | DNM2 expression (% control) | | | | IC50 (µM) |
|---|---|---|---|---|---|
| | 8 nM | 40 nM | 200 nM | 1,000 nM | |
| 695171 | 90 | 84 | 54 | 26 | 0.24 |
| 951371 | 105 | 67 | 25 | 9 | 0.10 |
| 951371 | 101 | 70 | 27 | 11 | 0.10 |
| 951371 | 109 | 63 | 16 | 4 | 0.08 |
| 951371 | 91 | 61 | 23 | 8 | 0.07 |
| 951371 | 94 | 78 | 25 | 9 | 0.10 |
| 951371 | 91 | 63 | 23 | 8 | 0.07 |
| 951371 | 59 | 66 | 23 | 8 | 0.04 |
| 951371 | 94 | 56 | 20 | 7 | 0.07 |
| 951371 | 88 | 67 | 26 | 10 | 0.08 |
| 988380 | 77 | 33 | 5 | 1 | 0.02 |
| 988386 | 93 | 70 | 21 | 6 | 0.08 |
| 988387 | 101 | 46 | 5 | 1 | 0.05 |
| 988388 | 97 | 80 | 39 | 11 | 0.13 |
| 988394 | 120 | 81 | 23 | 5 | 0.12 |
| 988396 | 113 | 87 | 30 | 9 | 0.14 |
| 988397 | 77 | 29 | 7 | 2 | 0.02 |
| 988398 | 86 | 46 | 11 | 3 | 0.04 |
| 988399 | 81 | 47 | 13 | 3 | 0.04 |
| 988400 | 88 | 54 | 15 | 3 | 0.05 |

TABLE 8-continued

DNM2 mRNA Expression

| Compound Number | DNM2 expression (% control) | | | | IC50 (μM) |
|---|---|---|---|---|---|
| | 8 nM | 40 nM | 200 nM | 1,000 nM | |
| 988401 | 98 | 65 | 16 | 6 | 0.07 |
| 988402 | 94 | 48 | 11 | 2 | 0.05 |
| 988407 | 99 | 77 | 30 | 8 | 0.11 |
| 988413 | 84 | 58 | 23 | 7 | 0.06 |
| 988414 | 95 | 73 | 23 | 6 | 0.09 |
| 988415 | 82 | 62 | 25 | 7 | 0.06 |
| 988422 | 91 | 60 | 17 | 7 | 0.06 |

Example 7: Dose Response of Modified Oligonucleotides Complementary to Dynamin 2 In Vitro Selected oligonucleotides listed in the Examples above were tested at various doses via free uptake in A431 cells. Cells were cultured at a density of 10,000 cells per well treated with 7.8, 31.25, 125, 500, or 2,000 nM of modified oligonucleotide, as specified in the tables below. After approximately 48 hours, total RNA was isolated and analyzed by RT-PCR with primer probe set RTS36027 (described in Example 1), normalized with GADPH. As illustrated in the tables below, DNM2 expression was inhibited in a dose-dependent manner by modified oligonucleotides complementary to DNM2.

TABLE 9

DNM2 mRNA Expression

| Compound Number | DNM2 expression (% control) | | | | | IC50 (μM) |
|---|---|---|---|---|---|---|
| | 7.8 nM | 31.25 nM | 125 nM | 500 nM | 2,000 nM | |
| 908166 | 106 | 97 | 57 | 28 | 16 | 0.22 |
| 908213 | 139 | 85 | 56 | 30 | 16 | 0.21 |
| 908408 | 98 | 80 | 33 | 7 | 2 | 0.08 |
| 908420 | 91 | 86 | 45 | 13 | 4 | 0.11 |
| 948660 | 105 | 90 | 51 | 13 | 2 | 0.14 |
| 948677 | 101 | 101 | 61 | 23 | 8 | 0.21 |
| 948951 | 97 | 79 | 35 | 14 | 8 | 0.09 |
| 949190 | 107 | 101 | 54 | 22 | 8 | 0.18 |
| 949865 | 94 | 80 | 40 | 16 | 7 | 0.10 |
| 949935 | 88 | 84 | 58 | 31 | 19 | 0.20 |
| 950023 | 89 | 75 | 45 | 13 | 4 | 0.09 |
| 950060 | 81 | 79 | 48 | 29 | 11 | 0.13 |
| 950089 | 84 | 79 | 53 | 18 | 5 | 0.12 |
| 950132 | 87 | 83 | 44 | 19 | 9 | 0.11 |
| 950183 | 88 | 83 | 58 | 35 | 15 | 0.21 |

TABLE 10

DNM2 mRNA Expression

| Compound Number | DNM2 expression (% control) | | | | | IC50 (μM) |
|---|---|---|---|---|---|---|
| | 7.8 nM | 31.25 nM | 125 nM | 500 nM | 2,000 nM | |
| 908408 | 98 | 80 | 34 | 10 | 2 | 0.08 |
| 951356 | 190 | 79 | 60 | 28 | 10 | 0.23 |
| 951362 | 97 | 85 | 63 | 30 | 11 | 0.21 |
| 951372 | 87 | 80 | 55 | 23 | 10 | 0.14 |
| 951431 | 100 | 90 | 68 | 38 | 21 | 0.31 |
| 951797 | 89 | 77 | 42 | 19 | 10 | 0.10 |
| 951798 | 89 | 58 | 23 | 6 | 1 | 0.04 |

TABLE 10-continued

DNM2 mRNA Expression

| Compound Number | DNM2 expression (% control) | | | | | IC50 (μM) |
|---|---|---|---|---|---|---|
| | 7.8 nM | 31.25 nM | 125 nM | 500 nM | 2,000 nM | |
| 951799 | 90 | 68 | 23 | 6 | 2 | 0.05 |
| 951816 | 100 | 77 | 38 | 10 | 3 | 0.09 |
| 951821 | 87 | 57 | 45 | 16 | 6 | 0.07 |
| 951827 | 94 | 79 | 45 | 17 | 5 | 0.11 |
| 951839 | 95 | 90 | 69 | 38 | 14 | 0.29 |
| 951845 | 92 | 71 | 31 | 8 | 2 | 0.06 |
| 951846 | 91 | 85 | 50 | 19 | 5 | 0.13 |
| 951856 | 97 | 86 | 54 | 22 | 7 | 0.15 |

Example 8: Dose Response of Modified Oligonucleotides Complementary to Dynamin 2 In Vitro Selected oligonucleotides listed in the Examples above were tested at various doses in HSMM cells (human myoblast, Lonza CC-2580). Cells were cultured at a density of 20,000 cells per well and transfected via electroporation with 7.8, 31.25, 125, 500, or 2,000 nM of modified oligonucleotide, as specified in the tables below. After approximately 16 hours, total RNA was isolated and analyzed by RT-PCR with primer probe set RTS36027 (described in Example 1), normalized with ribogreen. As illustrated in the tables below, DNM2 mRNA expression was inhibited in a dose-dependent manner by modified oligonucleotides complementary to DNM2.

TABLE 11

DNM2 mRNA Expression

| Compound Number | DNM2 expression (% control) | | | | | IC50 (μM) |
|---|---|---|---|---|---|---|
| | 7.8 nM | 31.25 nM | 125 nM | 500 nM | 2,000 nM | |
| 908166 | 104 | 95 | 98 | 66 | 42 | 1.29 |
| 908213 | 93 | 82 | 70 | 42 | 19 | 0.33 |
| 908408 | 111 | 100 | 74 | 38 | 17 | 0.36 |
| 908420 | 91 | 93 | 67 | 39 | 17 | 0.30 |
| 948660 | 88 | 86 | 83 | 42 | 15 | 0.40 |
| 948677 | 90 | 80 | 87 | 51 | 22 | 0.54 |
| 948951 | 88 | 74 | 57 | 31 | 12 | 0.16 |
| 949190 | 99 | 88 | 82 | 47 | 23 | 0.49 |
| 949865 | 132 | 106 | 92 | 39 | 19 | 0.50 |
| 949935 | 90 | 92 | 94 | 60 | 25 | 0.77 |
| 950023 | 113 | 97 | 86 | 40 | 15 | 0.43 |
| 950060 | 109 | 105 | 78 | 69 | 32 | 0.95 |
| 950089 | 111 | 102 | 80 | 54 | 21 | 0.58 |
| 950132 | 117 | 98 | 79 | 51 | 19 | 0.51 |
| 950183 | 95 | 110 | 84 | 59 | 23 | 0.70 |

TABLE 12

DNM2 mRNA Expression

| Compound Number | DNM2 expression (% control) | | | | | IC50 (μM) |
|---|---|---|---|---|---|---|
| | 7.8 nM | 31.25 nM | 125 nM | 500 nM | 2,000 nM | |
| 908408 | 98 | 102 | 81 | 55 | 20 | 0.58 |
| 951356 | 95 | 102 | 94 | 74 | 41 | 1.45 |
| 951362 | 95 | 67 | 85 | 56 | 29 | 0.62 |
| 951372 | 95 | 91 | 86 | 60 | 27 | 0.75 |

TABLE 12-continued

DNM2 mRNA Expression

| Compound Number | 7.8 nM nM | DNM2 expression (% control) | | | | IC50 (µM) |
| --- | --- | --- | --- | --- | --- | --- |
| | | 31.25 nM | 125 nM | 500 nM | 2,000 nM | |
| 951431 | 87 | 90 | 89 | 55 | 35 | 0.77 |
| 951797 | 94 | 94 | 98 | 72 | 41 | 1.40 |
| 951798 | 103 | 95 | 79 | 40 | 21 | 0.40 |
| 951799 | 104 | 100 | 81 | 47 | 20 | 0.50 |
| 951816 | 106 | 91 | 89 | 53 | 30 | 0.70 |
| 951821 | 122 | 106 | 66 | 32 | 22 | 0.32 |
| 951827 | 100 | 87 | 51 | 38 | 20 | 0.21 |
| 951839 | 123 | 94 | 99 | 72 | 31 | 1.17 |
| 951845 | 104 | 94 | 75 | 51 | 20 | 0.48 |
| 951846 | 112 | 91 | 80 | 59 | 27 | 0.69 |
| 951856 | 113 | 101 | 77 | 50 | 22 | 0.52 |

Example 9: Dose Response of Modified Oligonucleotides Complementary to Dynamin 2 In Vitro Selected oligonucleotides listed in the Examples above were tested at various doses in SkMC cells (human skeletal muscle, Lonza CC-2561). Cells were cultured at a density of 20,000 cells per well and transfected via electroporation with 7.8, 31.25, 125, 500, or 2,000 nM of modified oligonucleotide, as specified in the tables below. After approximately 16 hours, total RNA was isolated and analyzed by RT-PCR with primer probe set RTS36027 (described in Example 1), normalized with ribogreen. As illustrated in the tables below, DNM2 mRNA expression was inhibited in a dose-dependent manner by modified oligonucleotides complementary to DNM2.

TABLE 13

DNM2 mRNA Expression

| Compound Number | 7.8 nM nM | DNM2 expression (% control) | | | | IC50 (µM) |
| --- | --- | --- | --- | --- | --- | --- |
| | | 31.25 nM | 125 nM | 500 nM | 2,000 nM | |
| 908166 | 90 | 84 | 87 | 43 | 13 | 0.41 |
| 908213 | 101 | 79 | 59 | 21 | 5 | 0.15 |
| 908408 | 94 | 72 | 57 | 21 | 3 | 0.13 |
| 908420 | 84 | 72 | 53 | 9 | 4 | 0.10 |
| 948660 | 95 | 90 | 64 | 12 | 2 | 0.16 |
| 948677 | 88 | 77 | 58 | 15 | 4 | 0.13 |
| 948951 | 83 | 67 | 41 | 12 | 5 | 0.07 |
| 949190 | 103 | 84 | 61 | 16 | 4 | 0.16 |
| 949865 | 130 | 106 | 55 | 10 | 4 | 0.17 |
| 949935 | 118 | 100 | 86 | 33 | 7 | 0.36 |
| 950023 | 129 | 98 | 57 | 11 | 3 | 0.17 |
| 950060 | 101 | 103 | 72 | 26 | 5 | 0.26 |
| 950089 | 112 | 78 | 65 | 20 | 4 | 0.17 |
| 950132 | 115 | 93 | 53 | 14 | 3 | 0.15 |
| 950183 | 114 | 92 | 70 | 24 | 5 | 0.23 |

TABLE 14

DNM2 mRNA Expression

| Compound Number | 7.8 nM nM | DNM2 expression (% control) | | | | IC50 (µM) |
| --- | --- | --- | --- | --- | --- | --- |
| | | 31.25 nM | 125 nM | 500 nM | 2,000 nM | |
| 908408 | 91 | 80 | 46 | 10 | 3 | 0.10 |
| 951356 | 103 | 98 | 90 | 52 | 15 | 0.55 |

TABLE 14-continued

DNM2 mRNA Expression

| Compound Number | 7.8 nM nM | DNM2 expression (% control) | | | | IC50 (µM) |
| --- | --- | --- | --- | --- | --- | --- |
| | | 31.25 nM | 125 nM | 500 nM | 2,000 nM | |
| 951362 | 90 | 88 | 65 | 22 | 4 | 0.19 |
| 951372 | 99 | 88 | 65 | 16 | 4 | 0.18 |
| 951431 | 103 | 97 | 70 | 25 | 6 | 0.24 |
| 951797 | 102 | 94 | 69 | 25 | 7 | 0.23 |
| 951798 | 99 | 90 | 46 | 8 | 3 | 0.12 |
| 951799 | 101 | 90 | 49 | 12 | 3 | 0.13 |
| 951816 | 96 | 78 | 63 | 13 | 4 | 0.14 |
| 951821 | 104 | 79 | 47 | 12 | 3 | 0.11 |
| 951827 | 94 | 71 | 44 | 8 | 3 | 0.08 |
| 951839 | 114 | 103 | 76 | 32 | 6 | 0.32 |
| 951845 | 97 | 88 | 55 | 12 | 4 | 0.14 |
| 951846 | 90 | 86 | 41 | 18 | 4 | 0.11 |
| 951856 | 102 | 91 | 62 | 15 | 4 | 0.17 |

Example 10: Administration of Modified Oligonucleotides Complementary to Human Dynamin 2 to CD1 Mice CD1® mice (Charles River, Mass.) were treated with modified oligonucleotides selected from Examples above and evaluated for changes in the levels of various plasma chemistry markers. Groups of 6 week old male CD1 mice were injected subcutaneously once a week for 6 weeks with 50 mg/kg of a modified oligonucleotide listed in the tables below (50 mg/kg/week dose). Each group contained 4 mice. One control group of male CD1 mice was injected subcutaneously once a week for 6 weeks with PBS. Mice were sacrificed 48 hours after the last dose, and organs and plasma were harvested for further analysis.

Levels of transaminases, albumin, BUN, and billirubin were measured using an automated clinical chemistry analyzer (Hitachi Olympus AU400e, Melville, N.Y.). Kidney, liver, and spleen weights were also measured. The results, presented in the tables below, show that many of the modified oligonucleotides complementary to DNM2 were well tolerated in vivo.

TABLE 15

Levels of plasma markers

| | ALT (U/L) | AST (U/L) | Albumin (mg/dL) | BUN (mg/d) | Creatine (mg/dL) | T.Bil. (g/dL) |
| --- | --- | --- | --- | --- | --- | --- |
| PBS | 48 | 82 | 3.36 | 27.2 | 0.12 | 0.66 |
| 549144 | 72 | 68 | 3.23 | 23.6 | 0.12 | 0.47 |
| 908166 | 259 | 108 | 3.16 | 20.4 | 0.11 | 0.38 |
| 908213 | 93 | 85 | 2.95 | 23.9 | 0.10 | 0.34 |
| 908389 | 1073 | 636 | 3.17 | 22.7 | 0.09 | 0.55 |
| 908408 | 67 | 70 | 2.97 | 26.2 | 0.11 | 0.32 |
| 908415 | 286 | 209 | 2.60 | 26.2 | 0.10 | 0.28 |
| 908416 | 425 | 336 | 2.35 | 26.4 | 0.07 | 0.19 |
| 908420 | 105 | 144 | 2.50 | 26.5 | 0.06 | 0.38 |
| 948660 | 112 | 165 | 2.59 | 21.8 | 0.08 | 0.26 |
| 948673 | 225 | 263 | 2.15 | 27.2 | 0.04 | 0.82 |
| 948675 | 100 | 132 | 2.25 | 21.4 | 0.06 | 0.22 |
| 948677 | 65 | 91 | 2.32 | 17.7 | 0.05 | 0.21 |
| 948951 | 107 | 126 | 2.46 | 21.4 | 0.07 | 0.22 |
| 949158 | 713 | 608 | 2.99 | 18.6 | 0.01 | 0.27 |
| 949190 | 64 | 62 | 2.52 | 22.1 | 0.07 | 0.20 |
| 949865 | 45 | 58 | 2.62 | 23.2 | 0.06 | 0.22 |
| 949873 | 89 | 163 | 2.33 | 20.7 | 0.04 | 0.21 |
| 949874 | 1079 | 853 | 2.77 | 20.7 | 0.05 | 0.46 |
| 949935 | 98 | 81 | 2.63 | 22.9 | 0.07 | 0.20 |

TABLE 15-continued

Levels of plasma markers

|  | ALT (U/L) | AST (U/L) | Albumin (mg/dL) | BUN (mg/d) | Creatine (mg/dL) | T.Bil. (g/dL) |
|---|---|---|---|---|---|---|
| 950023 | 42 | 57 | 2.52 | 22.2 | 0.04 | 0.20 |
| 950030 | 59 | 77 | 2.44 | 20.6 | 0.05 | 0.21 |

TABLE 16

Levels of plasma markers

| Compound No. | ALT (U/L) | AST (U/L) | Albumin (mg/dL) | BUN (mg/d) | Creatine (mg/dL) | T.Bil. (g/dL) |
|---|---|---|---|---|---|---|
| PBS | 37 | 62 | 2.78 | 22.0 | 0.08 | 0.46 |
| 549144 | 64 | 79 | 2.64 | 24.0 | 0.08 | 0.29 |
| 950060 | 47 | 63 | 2.47 | 22.0 | 0.09 | 0.33 |
| 950089 | 40 | 56 | 2.65 | 21.0 | 0.10 | 0.22 |
| 950132 | 58 | 58 | 2.58 | 20.0 | 0.07 | 0.24 |
| 950183 | 49 | 62 | 2.38 | 21.0 | 0.06 | 0.29 |
| 951356 | 64 | 80 | 2.39 | 23.0 | 0.10 | 0.25 |
| 951362 | 60 | 63 | 2.74 | 22.0 | 0.09 | 0.18 |
| 951371 | 312 | 209 | 2.32 | 20.0 | 0.09 | 0.18 |
| 951372 | 59 | 99 | 2.54 | 25.0 | 0.07 | 0.21 |
| 951407 | 172 | 200 | 2.72 | 24.0 | 0.07 | 0.24 |
| 951431 | 64 | 80 | 2.48 | 23.0 | 0.08 | 0.22 |
| 951793 | 319 | 238 | 2.5 | 19.0 | 0.10 | 0.20 |
| 951797 | 41 | 63 | 2.6 | 24.0 | 0.11 | 0.26 |
| 951798 | 53 | 97 | 2.57 | 26.0 | 0.10 | 0.19 |
| 951799 | 44 | 97 | 2.44 | 25.0 | 0.08 | 0.19 |
| 951816 | 121 | 113 | 2.63 | 19.0 | 0.10 | 0.20 |
| 951821 | 79 | 80 | 2.39 | 23.0 | 0.07 | 0.17 |
| 951827 | 56 | 88 | 2.46 | 25.0 | 0.10 | 0.21 |
| 951839 | 45 | 50 | 2.52 | 23.0 | 0.08 | 0.20 |
| 951845 | 117 | 132 | 2.51 | 21.0 | 0.08 | 0.25 |
| 951846 | 35 | 47 | 2.59 | 21.0 | 0.10 | 0.21 |
| 951856 | 112 | 412 | 2.25 | 20.0 | 0.09 | 0.17 |

TABLE 17

Organ weights

|  | kidney (g) | liver (g) | spleen (g) |
|---|---|---|---|
| PBS | 0.55 | 1.9 | 0.09 |
| 549144 | 0.52 | 1.9 | 0.10 |
| 908166 | 0.48 | 2.0 | 0.08 |
| 908213 | 0.52 | 2.0 | 0.12 |
| 908389 | 0.54 | 2.6 | 0.14 |
| 908408 | 0.49 | 2.2 | 0.13 |
| 908415 | 0.51 | 2.2 | 0.12 |
| 908416 | 0.51 | 2.1 | 0.16 |
| 908420 | 0.52 | 2.0 | 0.13 |
| 948660 | 0.44 | 1.8 | 0.14 |
| 948673 | 0.51 | 3.9 | 0.62 |
| 948675 | 0.48 | 2.1 | 0.21 |
| 948677 | 0.54 | 2.0 | 0.15 |
| 948951 | 0.45 | 1.9 | 0.11 |
| 949158 | 0.59 | 2.3 | 0.18 |
| 949190 | 0.53 | 2.2 | 0.14 |
| 949865 | 0.53 | 2.1 | 0.14 |
| 949873 | 0.47 | 1.8 | 0.20 |
| 949874 | 0.52 | 2.3 | 0.16 |
| 949935 | 0.57 | 2.0 | 0.13 |
| 950023 | 0.53 | 1.9 | 0.16 |
| 950030 | 0.59 | 2.1 | 0.20 |

TABLE 18

Organ weights

| Compound No. | kidney (g) | liver (g) | spleen (g) |
|---|---|---|---|
| PBS | 0.57 | 2.1 | 0.11 |
| 549144 | 0.57 | 2.0 | 0.09 |
| 950060 | 0.57 | 2.3 | 0.12 |
| 950089 | 0.60 | 2.4 | 0.15 |
| 950132 | 0.59 | 2.3 | 0.16 |
| 950183 | 0.60 | 2.4 | 0.14 |
| 951356 | 0.57 | 2.4 | 0.19 |
| 951362 | 0.58 | 2.3 | 0.16 |
| 951371 | 0.51 | 2.7 | 0.16 |
| 951372 | 0.55 | 2.5 | 0.17 |
| 951407 | 0.53 | 2.2 | 0.17 |
| 951431 | 0.54 | 2.2 | 0.18 |
| 951793 | 0.55 | 2.6 | 0.17 |
| 951797 | 0.52 | 2.1 | 0.15 |
| 951798 | 0.57 | 2.4 | 0.18 |
| 951799 | 0.54 | 2.4 | 0.16 |
| 951816 | 0.50 | 2.4 | 0.16 |
| 951821 | 0.50 | 2.0 | 0.13 |
| 951827 | 0.47 | 1.8 | 0.13 |
| 951839 | 0.51 | 2.2 | 0.15 |
| 951845 | 0.55 | 2.0 | 0.17 |
| 951846 | 0.57 | 2.2 | 0.17 |
| 951856 | 0.60 | 2.5 | 0.19 |

SEQUENCE LISTING (3135 sequences)

SEQ ID NO: 1 - DNA, 120000 bp, Homo sapiens
gctcacacctgtaatcccagctactctggaggctgaggcaggagaatcacttgaacccaggacgtggaggtggcagtgagccgagatcgcaccactgcacgccaccctgagagacagcgagatttcgtctaaaaaaaaaaaaaaaaaggttggacgtggtggtggctcacacctgtaatcctagcactttgggaggccaaggagggcagatcatgaggtcaggagttcaagaccagcctggccaacatggtgaaaccccatctctactaaatatacaaaaattagctgggtgtggtggcacgtgcctgtaatcccagctactctggaggctgaggcaggaatatcgcttgaagccaggacttggaggttgcagtgagccaagatcgcactactgtactccagcctgggagacagagcaagcctccatctcaaaaaaagaaaagaaaagaaaaaaaaagtccaagcgcggtggctcacacctgcaatcccagcactttgggaggccaaggagggagggtcatctgggtcaggagttcgagaccagcctggccaacatggtgaaaccccatctctactaaaaatacaaaaattagccaggtatggtggcaggcgcctgtagtcccagctacttgaaaggctgaggcaggagaatcatttgaacccgggaggcggaggttgcagtgagctgagattgcatcactgcactccagcctgggctacagagcaagactctgtttcaaaaaaaaaaaaaagtgaaaaagtaatacatgtatgtaatccacaattcaaatcacatcaaaagtgcaactacttttatcaatttatgtatttttccagcaattttccgtgtgtacatatggttttcatgcatgtcagcatccttcacacacagttctgtaccttgcttgttttttcctcttagtatatctcaaattatttatacttcagtacatgaagagtttcctcaacgtttttgtttgtttgtttatttgtttttgagacggggttttgctcttgttgcccaggctggagtgcagcggtgcgatctcagctcaccgcaacttctgcgtcccgtgttcaagcgattctcctgcctcagcctctcgagtagctgggattacaggcacgcaccaccacgcctggctaattttttgtatttttagtagaaacgtggtttcactatgttagccaagctggtttcgaacctctaacctcaggtgatctgccctccttggcctcccaaagtgctgggattacaggcatgagccaccgcacctggcgctttttgcctatttctttgagacctggggttttgggtcacaaaacaggcaaatgccatgagccaccctcctcctctttctccatcttcttgtgctgcctcaggtcagagcacttacctgctcctgccttctcactgggtttccttgtctctggcctatttgtctccagaggggtcaaaacacttcaaatcctcctatttgtctctgtccactgtcaggagttccagttcccagaaccccaattttgcctacaaaatagcgtgtcttttcacggggagaggatttgttgagttttagtgggtactcaaaaagatctaaagccagttgggggggttcacacatgtaatcccagcacttttgggaggccggcctgtgagggtcgtttgggcgcaggagtttgagaccagcctggacaacacagcaagaccctgtctctataaaaaataaaataaaaataattagctgggcatagttgcgcacgtctgtggttccagctactcgggacgctgaggcgggaggatcgtttgagcccaggtgcttgttgaattgagctatgagtgcactactgcaccccagcctgggcaacagagtaaggacccagtttctaagaaaagaagattcattagctagacgcggtggctcacacctgtaattccaacactttgggaggccaagacgggcggatcacttgaggccaggcgttcgagaccagcctggccaatatggtgaaaccccgtctactaaaaatacaaaattagctgggcgtggtggctcacacttgtaatcccagctattcgggaggctgaggcaggagaattggttgaaccggggaggcggaggttgcagtgagccaagatcgcgctactgcactccagcctgggtgacagagtgagtaccccgcctcaaaaaaaagaaaagaaaaaagattcatgatctgctaaagttgaagaagtgggggaaaacattggagtgttagcggcgtcaagatcgggcgtgagcagaaagggcacagcatttgcaaaggcgtggaggagtgattttattgcgttctatccctaggaagcaatgacttggcctctaccatttgcagagcgcattgggaccctgctcccagagctggtttgcagtctgggaactgagatgcgctctgggacttgtagttttccccagtgccaggaaactcaaaaatcgagacatcggatcccaccacgaggtgtcgcccttgagcgagtacggtgggatctatcctatacttcagaaggctgttgcagacatccaacaatcacaaggaagaacgggagtttttctgattgacagatatggttctcaatgatagtcaagattcggatgttaaagcccgccctcttttgcctggttggctggagcaacgaagtgatatttatatgaaccaatgggaaattcttagggaacgaggtagtagctcaatccccaacaccattggtccacattgtctactggcacgtctgcctgccaataagatggtggaacttcgccaatgggcagagccaacgtgcctttttcggaaacacccccttcctctcttgacaacttgctttctgccgctattggctgttgcacaacagtgacggttcttttgtccaataagtcagcaagacggtccccagggggaaggtttactcaaccataggcccgtgcctagtttttattggctagtgtatccgagtggcggtgcagcaggccagtcgcgtgcggcgcgagtgctttgggcgcagcccccggggccggggcgggaggtcgctcgggtcgggtgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccggtgagcgggcgcggcagggatcgcgggcgggtggcggcctagggcgcggagggcggaccgggaatggcgcgccgtgcgccgccggcgtaactgcggcgcttgcgtgcccgcggcggggaaccggacggggtcggggaggcgggccctgtgggacgccctgggcagaggactccctgcaggggctccggagcaggcccgggccccaggggcggtgtcacgggccagggcgccgtaggacaggaggtgcgctggaaccctgcggtccatctggtcccagctttcgtgggtgaagtctgccatctggttggccgtgggtctggggtagatccctcttctgctctttcgggctgtccatcagaggtgaaaccggccatctagatatctattggggcgaccgctgcggtctggctggcttgttcttgtatctggagctgcccccgccgtctggttggctgtctctctgtcctgggcaagcctccctgccaccaccatttggttgtccatctgtccagtcccacctggcagccccctgctgtctggctagctgtccagggtgacctctgctgtctggccgcccatccgtgcccctcacagactttaacactgagcagtccctctgttgggtgacaccagctggcctctactgtctgactggctagctgactcctaggggaccctgtttgattctctctggctgactcttacagcttgattcctggctagcgctggctcctctcttccgtgtgaattcttctgtctgtctggccatctcctagtctgcccatgactacccctgagtgtctggcacaacggctctggaaaggggtggtaggagggtagaggggagaacagagctgaaggaggaggtttggaccctacttcccctctcagctggaaggaggactctgggggtaccttacttcaggattcctttccgagtgctagaacacaggggcccgcctcccagctacagcctacaaattgggggccctcctttggagcctgggaaggggcttcttgcgtgatcaggcctcagtggctagcgctgggatgtagccttctctggacagccttgagaagccgcggtgtgcccatctgtccagtgggcaaactccactctctggggctgtttccaggattcaggaagcaaatgaatgagaacagcccgtgcagccacctctccctcccaccaacccctcttgcctttcttgtctcccagatgggcggccacttctccattccaggaactactcatttgtggtggtgtggctgccaaatgataacatcctcctcctgtcattattgtcattgttattgttgttatcattgtcaagggataatgtcccttcttgattcaacatcttgaatcccaagtaaggagtggggtggaggctgtgttatcatccccaccttagctgagctgggaggctcagaagggactgtgatcacccaaggccactaggctggcgtaaggccttgtgtctgccatcccagagccttggggctttgctccaagcagcacaaatctcctcttttgctaccttgtctctagctcattgccttctgtctaccgtggtggaaaggtgtggacttgcagccagctgggcctggcctgatctcaggctggactgtggtgtgggcccctttgagtgaccatcttcctgcctgcccaggcttctgggacgggggtggggggtgtttgcaaagctctgtctctttcacttgccttgtgaccttgcacaggttgtcttggcctctctaagtcttggttgactctcctaaacaagtttattttattttatttatttatttattttttttttttttgagacagagtctccctctgtcatccagtctggagtgcagtggagcaatcttggctcactgcaacctctgcctcccaggttcaggccattcttctgcctcagcctcccgagtagctgggattacaggcgtctaccaccaagcccaactaatttttgtatttttagtagagacggggtttcaccatgttggccaggctggtctcaaactacttacctcaagtgatcctcatgccttggcctcccagagtgctgggattacaggtgtgagccaccaagcctcgccccaggagttccaagaccagcctgggtaacatgacaagatgccattctacaaaaaataaaaaaattagccaggtagggtggtagtcccacacctgtagtcccagcaactcaggaggctggccctgggaggactgcttgagcccaggatgtccagactgcagtgagccgtgattgcaccattaccctccagcctgggtgacagaaccagatccggtttcaaaaaaagaaaagaaaaagtgcttacttacctaacgcactgcctggcacatagtaggtctacatggatggggctattgttgtttatctggctggttcctttgctatcagggacaaaagctaaccagaatgaaagtgctttcacgttacacacttaagccttatgagggaggcattgctataatccccattttacagagcaggaaactgaggctcagatagctgagcagaacactctcactggaggctgtaaagtgaggagttaggtgttctgggttgggaacctgggtctctctcccatccttacctctcctcagtccctctaccccttgcctttctctcctgtctaccatggtgtctggcagctgccggccagtatggagctggttcctgtggcgacctcctagaatcctgcaatgcaggagttgctcattatatatatatttttacaccgagtctcactctgttccccaggctggagtgcagtggtgttatctcagcttactgcaacctccacctcccatgttcaagcgattctcatacctcagcctcccgagtagctgggattacaggcgcgcgttaccacacccggctaatttttgtatttttagcagagatggggtttcaccatgttggccaggctggtcttgaactcctgacctcaggtgatccgcccacctcggccacccaaaatgctggcattaaaggtgtgaaccaccatggctggcctcgttaagagtattaattcagtacctgaaagccaaagttgtaaaaaggcctctctttgggtatgaggggctcaaacaaggcttacttttttttgggggggtgtaagagataaggtctctctttgttgccgaggttggagtggaggggtgcagtcctagctcattgcagcctcgaactccagggctcaagcaatcctcctgcctctgcctctaaaagcactaggattacaggtgtgagccattgcgccgagcctggattttctaaggatgtggtccgagtgggaacagcccagttagttcagccctatagctggaagtccagatcactggctctgggggccaaggcctgcctgctgggtcttttgttttacctgcgtagcttttgtttttaataagactttccagtgttagatttccagtcaatatccggatttcttgtggctctaagacactcagatctatagagttctgagttgtcatgcaaaggctgtgggcctaaggcctggttccaccatgtctggctgtgcgactcggccacgtggatttggcgttctgggcctcagattccttttctgtaagctgagggtggtaactggtaccctggggcctagatgggtgattgggtgatgcgtgccgagtgcatgtgtcttatacgcatggtggctgttgttgtaatcagtttcacctggcgttgctgagcctttgtcccttgtggcagtaatggcttcgatttcagaagcaccagtcactgtcccatcagactaagagtggccactccagctgccacagtccccactactccctagcactcacccaggcctagatcattttgcttggagcctcctggccctggaacctttgagtttgagacccctggcttgtctgcggtgcaccagcagatagaactttggccctaaggagaaaggagggcatcactccctcttgacccttgtcatttagcctcaggggctggccagaaggaaggccttaggcattcccgcaccctagcctcccgagtagctgggactgcaggcacccgccaccacgcctggctaatttttgtatttttagtagagacgaggtttcaccatgttagccaggatggtctcaatcttctgaccttgtgatccgtccacctcggcctcccaaagtgctgggattacaggcgtgagccaccgcgcctggcctgagatagggtcttatactgtcacccaggctagagtgcagtggcaccatctctgctcactgcagccttgacctcctgggctcaagcgattctcctacctctcagcctcctaagtagctgggactacaggcacgtgccaccacgcttggctaatttttcattttttgtagatacagggccttgctgtgttgcccaggctggtctcgacctcctcgcctcaaatgatcctcctgcatcagtctcccaacgtgctggcattacaggtgtgagccactgcgcccagcctcctcttcattaaaatacaagttataatagcacttctttccctttcttttttttttttgagacggagtctggctctgttgcccaggctggagtgcagtggtgcgatctcggctcactgcaatctcgcctcctgagttcaagtgattctcctgtctcagcctcccgagtagctgggactacagttgcgagccaccacacctggctaatttttttttttttttttttgagacggagtttcattcttgttgcccaggctggagtgcaatggcacgatcttggctcaccgcaacctcccctcctggtttcaagccattctcctgcctcagcctcctgagtagctgggattacaggcatgcaccaccacgcctggctaattttgtatttttagtagaggcggggttttcccgtgttggtcaggctggtctcgaactcccgacctcaggtgatctgccggccatggcctcccaaagtgctgggattacaggcgtgagccaccgtgcccggctaatttttctatttttaatagagatggggtttcgccatgttggccaggctggttccaaactcctgacctcaagtgatcttcctgccttggcctcccaaggtgctgggattgcaggtgtaagccaccgcgcccagccccgtcttctttaaaataggagttataatagcacttctttccctttcttgaatagggattaagtgagacagtttggagtgcttggcatagaagaagtgcttaaaacattaggtgttgttcgttcattaaaaaatgtttcctgagtacttttactgtgtgcctggggacatggccctgagcaagttaccagaacttctgctctggaggagctggcctttcagcaggaagcaaataaaggagaagcatgggccacttagtggctcaggcccacaatctcagctctttgggatccaggcgggaggatcacttgagcccagaagttggagaccagcctgggcaacatagaccccgtctctacaaaaaataaaaacattagctgggcatggtgacacctgtagtcccagctactcaggaggctgaggccggaggatggcttgagcctgggatttcaaggctgcagtgagctctgatcacgctactgccttccagcctgggcggaagaacgagacctcgtctcaaaaaaaaaaaaaaaggcgataagtatgatggaaaaaaggatcaaggagcaggatgagggagagatcacagttggagggggtacattttattttattatattattattctttgagacggagtctcactctgtcttccaggctggagtgcagtcacgcgatctcggctcactgcaacctccgcctcccaggttcacgccattctcttgcctcagcctcccgagtagctgggattacaggcgcctgccaccaggcccggctaattttttgtatttttagtagagatggagtttcaccatgttagccaggatggtctcgatctcctgacttcgtgatccgcccgcctcggcctcccaaagtgctgggataacaggcgtgagccactgcgcctggccagagggggtacattttaaatagggaaattggtgacatttgagcagagccttgaaggaggcgaggaaggaacccctggagacgggaagagaatccagtgcaaaggtcctgatgtgggaggatgcccggaggccagtttagcaggccagtggagggagatcagatctgggagatattagggtgggaccaggcctctaggaacattgtgggcagggaggctgtctgagcagagggaagtaaagctggtggcgctactgctgtccctctggacctggccaagctgagggctctctcctttgatttccagcttcaactcagttttctcagtaagcagactccacaggcatgtaggcgccccgtgccatttttcttttaataagaagcagctgtgccggggatgctggcgtttccagctgcgtttttatttggcctttggtgatgtgtccctccagggatatgtggatgagccgcgggggcactgcctgtgcctcagtgggtgctgcaccagtgcacatcggatgcccgttggctcctgtccctgacagatggaggggcacgtgatgtgttccttgggctggtttgtccctttaacagatcttattagtttagagccacttggaaatgacatcttctgtttccagtgactttccttttgggcaaagacaaattgcatcttgaaaaggccatacatggccgggcatggtgactcacacctgtaatcccagcattttgggaggccgaggcaggcagatcacaaggttgggagtttgagaccagcctggccaacatagtgaatcccgatctctactaaaaatacaaaaattagccaggtgtggtggcgcatgcctttagtcccagctatttgggaggctgaggcaggagaatcacttgaacccaggaggaggaacttgcagtaagcggagatcacgccattgcactccagcctgggggacagagtgagactccatctcaaaaaaaaaaaaaaaaggaaaaaaggaaaggccatgcaaggctcggttagggtggtctgcagtgctgggcctgctggaattggtacagtccagagggatctgtgggaatatggaaggcttggttctgccacacaccaaaaaagtgacctcacttctctgggcctcagtttcctcatctggaaaatgggaacatggtggtctctgcctactgggagtggactgagaatcacgtagcaaattgttgtgaaacaggcagcatttgtgatctcgttggttggcttttgtctccttttatctgggatcaggactctgatgacaggtgtacgtttcttttctcttgctctgtcccccagactggagtacagtggcgtaatcatggctcactgcagcctccaactcctgggttcaggtggtcctctcacctgagtctcctgagtagctgggactataggcatgagccaccacacctggctaattacaaaaaaatttttttggcagggagcgatggctcacacttgtattcccagcacttggggaggccgaggcgggcggatcacggggtcaagagattgagaccatcctggccaacatggtgaaaccctgtctctactaaaaatccaaaaattaggtgggtgtggtggctctcacctgtagtcccagctgctcgggaggctgaggcaggagaatcgcttgaacctgggaggcggaggttgcagtgagccgagatcgtgccactgcactccagcctgggcgacagagcgagactctgcctcaaaaaaaaaaaatttttttttttttagagacagggtcttactttgttgctcagtttggtgtcaaactcctgggcccaagcgatcctcctgccttggcttcccaaagtggtggaattacaggtgtgagccgccgaacccggccttagtttctttttccttaaagagaaggaactcatcattactctgttgatataaatggagtgcctatcagtgcaggcaatgttcttgctctggggatacagccaggaccaggacatgcaggcacgccctgttccccagatcctgaaatatcgaccagaagttgttcctggttcctttctaagtgggaatcatggctgcaaacaagtaattggccgtgagagttatttacacacattttgtgtacggtgatgagaaatgggagaaaaaatgcccagcatcggatcaccagaggtcaggagttcgagaccagcctggccaacatggtgaaccctcatctctactaaaaatacaaaaattagccgggcgtggtggcaggcgcctgtaatcccagctattcgggaggctgaggcggagaatcgcttgaacctgggggacggaggttgcggtaagccgagattgcgccgctgcactccagcctgggcaacagagcgagactctgtctcaaaacaaacaaacaaacaaaaaccaatgataggggatttggccagataagcgtgtccagacaaccgactatcaactcgctactcagagggatctagaagaatctttaatgacccagaaagctgcacaagacctgttaggtaccagatgaaatgggctgtgggatcctgtcttgtttaaaacgattgtatttgctcagtgaaaagaccggaaagacatactctgccctaaccccacatgtgaatcgtctccccatgtgattcttggtttgtttttgctggtttggggattaggtttataatcaggaagacagatttctccaaagctgcgctctaggctgtccaagtgctttttcagagttacttattgacggataacagcccttgataggttcataacattgaaatcccctggtaataacctggattgtttctggatgagggcggaagatggccttggggacagttgtagatttagagaggaggttttcttttcttttctttttctttttttgtttttttttgagacgggatctcactctgttgcctaggctgaaatgcagtggcgtgatcacagctcacagcaacctcaacttcctgggctcaagggatcttcccacttcagcctcccaattagctgggaccacaggtgtgcgccaccacccccagctaattttaagaaattttttgtagaggtggggtctcattattttttgcccaggctagtctcaaacccctgggctcaagtgattctcctgcctcggcttcccaaagtgctgggattacaggcaagagccacggcacccggcctaggttagatttagagttttcagagttggcttaggcggtagaggctggcctttgaatggaaccctgtctcgctgtcgctctcagcgtttatatttggctcagagccacatctgccaaacttctgcccgatttgaatgaaagtgctgaaattataggcccctcggctgctgaaaaaaagtgagaacatcatgtaaaccgtaatttactgggattgccaactacaagctgtaattaagcccttattgtgttaaagctttggaaaaatccaagccaataatgagatatttatagggcattagctacaatctgaataaagggaaaatgtggccctgcgtctgaagcaggactgcaaagagaggaaagacgcctgcttccgggtgcgttttgggtttctgtgaatattggtaactaggtccctgctgggtggtgggaaattttcccctgtggcgtcacccgtagcttgaaccgggagctggatgactgtttcagtttcatctgctgctggacatttatgatgttaagagccagtgtttatggagaatcaccgtgtgccacatgtgcaagatctgaccagtgtcttctctgcccaggggtggcagctgctgctcttagcatccctgctttataggtagagaaactgaggccagagagggagactggcctgaagtcacacagggaggaggacagaggagttggagcttgaactggatgtgggccctctagagccacacatatggcggctttgggtgggaaggtgtgggcctgactcttgagagcagggctgaatggtgggcaccatggcgtttgtatctgaggactgggccaagattacagagggagtgagcaacgcgtggctttggatatgcatcgaggttgtcagctctgtgtccagcctgcgtgtggtaagcagcaaccactctacaccagttgctgggcacccagcagggactgggacagacaggacaggtgaacagttaaatgagcaagaacattctggggcaggcacaggggctcacacctgtaatcccagcactttgagaggccaaggcgggcagatcacttgaagccaggtgttcgagaccagcctggccagcatggcgagccccatctctaccaaaaatacaaaaattagctgagcatggtggtacttgtctgtcgtcccagctacttagcaggctaaggtgggaggatctcctgagcccaggaattcgaggttgcattgagctatgattgcaccactgcgctccagcctgggtgacagcaagacccggtctcaaaaaaaaaaaaaggctgtatgcggtggttcacgcctgtaatcccaacactttgggaggctgaggtgggagttcgagaccagcctggccaacatggcgaaaccccatctctactaaaaatataggcaggagaatggcgtgaacccgggaggcggagcttgcagtgagccgagatcgcaccactgcactccagcctgggcgacagagcgagactccgtctcaaaaaaaaaaaaaaaaaaaaaaaaaatataaaaaattagccaagcatggtggcgggcacctgtaatcccagctactcgggaggctgaggcaggagaattacttgaaggttgcagtgatccgaggtggaggttgcagtaatccgagatcatgccacggccctccagcctgggcaacaagagcgaaactctatctcaaaaaaaacaaaaataaaaatattctgaagagtgagaagcggtttgccctgtactgcattgggtgggggaatggctgcagggggctgcttcacatgtggcttgttgggatgggtgtcctgcagtggaatagccccgccaggacttgggggaacagcatcgcaggccagggaaacagcaggtgcagaggcctcgcacacacccggcccgctgagtgccccctgcggaccggaaaggaccagtaggcacgtgagagttaggacgctgcccgtggaatgccgacttttctaaatttgaattacgcaagtagagcgtggagacagtgttcttggaaaaagggaaaccattacagatgaggaagagcacactgcccagcccgtcccttcctccagctctacctgggagcaccactgtcacttcagggtatgtctagccagacccctctggtgtttctgtacttaggtacatgctggtacctatagagaatacgtggcaccattatgggtggttattttttttttttttggaacaggtctcactctgtcacccaggctggagtgcagtggcacagtcatggctcgctgcagccttgacatcctgtgctcaagccatcctcctacctcagcctcctgagtacctgggacaacaaccacatgccaccacgcccaactaatgtttataatcttttgtacagatggggtttctctatgttgccaaggctggtctcaaactcctgggctcatgcgatcctttcacgttggccccccaaagtactgggattgtagacatgagccacctctcccagccacgtgcatatatttgttgaatgaaagtagctaaaggctggaagtggtgactcacgcctgtaatcccagcactatgggaggccgaggcaacatggcttgagctcaggagtttgagaccagcctgggcaacatggtgagacctcgtctctaccaaaaatacaaaaattagcaggcgtggtggtgcatgcctgtactcttagctacttggaatcccgaggtgcgaggatcccttgagctagggtagcggtggaacttgcagtgagcccacactgtgccattgcactgcagcgtgggtgacagagcgagaccctgtctcaaaaaaaaaaaagtagctaaaaaccagaatggagtgaatttcactgcacagtcatggaggggaccaggcagaggacagccctgggtcttggttttggagactcacagcctgcctggggatgcagggaccctgaagcaaggacatcttcctttggaggaagtggagatttgctccatctatataaagagtaataacagtaataggctgagaccctgaggctgggcagcgtgggtgtctatctgcgttggcttcgagggctgtaagatggggctagcagcgtcccctccagggtgggagtgaggccctgtatggcaacctgcggggtgccccctctgacttttgcttcctgcctggctgctcagtggccctggcaggggcaggcaccactgctctttctgttacaagagacctcctttggataaatctgaacacgctcccatggcagacctatggggcggtagacaagaggccagcagagctgtcccaggccctggtgacacctccatgcccaggtgaaggaggagcaggctacttggagcctgccctgtgacacactttcgcggtgatgagagcttctcagggctgcgatcctggcgggccagtcaagcgggcaggagcagccccagccagggtgaccctgcctgctgggtgatacgccctggcacgaccaggccagccctggggaaagcccccagggcggatcagggagggacacagctgtcctggccatgagacttctgtcttttgtatggatacacagggtccttctagagggtcacagcctccacccccgggaggcctaccagctggccgcgcagccaggatcctgcagccaccaggacactgcctttccaggttgttcttttcttttccttctttttttttttttttttgaggcagagtctcacagtgtcgcccgggctggagtgcaatgcatgatctcagctcactgcaacctccacctcctgggttcaagtgattctcctgcctcagcctcctgagtagctgggattacaggtgtgcaccaccacgcctggctaattttttgtatttttagtagagatggggttttgccatgttggccaggctggtctcgaactcctggcctcaggtgatccacccgcctcggcctcccaaggctctgggattacaggcgtgagccgccgtgcccggcccccaggttgttcttttctacatcaacatcaggggacagtgactgagagaggccacgagccactggctcagcttgacgaaggcttcctgtggtttgggttgatgtatctctctgtcttgcaacactgagttccccgttgtctgggcggaagccagtcagacggaagcccggcttctgtggtgcctgccctggtggcctggacaggttgctgggaagctcaggtcaggctgctttctgaggtggggaggccccacctggaatgtgctcccagcactgggtgaaaattgatgcacaggcttgattttttttttttttttttgagacggagtttcgctgttgttgcccaggctggagtgcaatggtgcaatctcggctcgctgcaacctccgcctcccaggttcaagcgattcttctgcctcagcctcccgagtagctgtgattacaggcgtgcaccatcacacccggctaattttttgtatttttagtagagactgggtttcaccatggccagactggtcttgaactcctgacctcaggttatccgcctgcttcagcctcccagagtgctgggattacaggcatgagccaccgcgcccttaaactcttttctgttaaaggagttattcaactgtttactcgttgtggagaaaaaaaaaaaaaaaaaaacaggccgggcggtggctcatgcctgtaatcccagcactttgggaggccgaggcgggcggatcacgaggtcaggagattgagaccatcctgactaacacggtgaaaccccacctctactaaaaatacaaagaattagctgggcgtggtggcgagcgcctgtagtcccagctactcgggaggctgaggcaagagaatggtgtgaacccaggaggcggagcttgcagtgagccgagatcgcgccactgcactcccgcctgggtgatagagcgagactccgtctcaaaaaaaaaggaaaaacaattcaccctgtccggaagtgcacagagtaaggctgggtgtcctttgcatgggaacgacctctagcagtctgtggctcttgccagattttttatatatatatatatatttctaggtgtgactacccccgactcatccaaccagtgagcctataagtctagtaacaaacgctcccgctccacagtccaaagtctcaacagaatgtgactgtcttgcaccaggtccctgctatatttagtgcctccaagaatgtttggcttttgttttctgttttttttttcttttgagacaaagtctcgctcttgttccccaggctggagtgcaatggcgcgatctcggctcactgcaagctccgcctcccaggttcaagcgattctcctgcctcagcctcccgagtagctgggattacagacacctgtcaccatgcccagctaatttttgtagttttagtagagatggggtttcaccatgttggccaggctagtcttgaactcccgacctcaggtgatccaccctcctcggcctcccaaagtgctgggattaccagtgtgagccaccgcgcctgggctggtgtggtttttttttttttttttggagacagggtcccactctttcacccaggttggagtgcagtggcatgatgtcggcttactgcaacctccccctctcgggctcaaaccattctcccaccacagcctcccaactagctgggaccacaggcgcgcaccacaatggccggcattttttttttattttcggtagagacagggtttctccatgttgcccaggctggtcttgaactcctgagctcaggtaatctgcctgcctcagcctcccaaagtgctgggattgtaagcatgagccacaacgccctgcctagaaataattttagatttagagaaaataaataagcttcaaatttacagaaagtacaaagataacacagagagctcctgtacatccttcaccagtgtcctctaattttatatttcttacaaccaagaaattaacctagctactcaggaggctgaggcgggaggattgcttgagtctaggagttaaagcccagctttggcaacataacctcttctctaaaaataaatgaatgaggccggacatggtggctcacgcctgtaatcccagcactttgggaggcagaggcaggtggatcacctgaggtcaggagttcaagaccagcctggccaacatagcgaaaccccatctctactaaaaatacaaaaaattagccaggtgtggggacatgtgcctgtagtcccagctatttgggaggctgaggcaggagaattgcttaaacctgggaagcggaggctgcagtgagccgagatcgcgccactgtacttcagcctggacaacaaaaggagactccatctcaaaaaataaaaaaaaaaaaatgaatgaatgaaattaaccttggtatactactattaagtgaggcctggcgggatgttgtggctcacactgtaatctcagcactttgggaggccaaggtgggtggatcacttgaggccaggagtttgagaccagcctagacaacatatcaaaaccctgtctctacaaaaaattgagtgtggtggtatacacctgtagtcccagccactcgggaggctgaggtaggagaattgcttgaacctgagaggccaaggttgccatgagctgagatcaagccactgcactccagcttgggcaacagagggggactctgtctcaaaaaaaaaaaaaaaaggaagggaggccaggtacagtggctcacacctgtaatcccagcactttgggaggctagattgcttgagcccaggagttttagaccagcctgggcaatatagtgagacctcgtgtgtagaaaaaaaaaaaaattagcttggcctggtggtgctcacctggagtcccagctcctctggaggctgagacaggaggatcacttgagccctggaggttgaggctgcagtgagtgatgattgcaccattgcacaccagcccgggcaacagagccagaccctgtctcaaaaaaaaaaaaaaaaaaaaaaagccaaagccagaatgtacagatttcttcaatttttcccatatgagactaatttaaaaaaaaattttttttttttatcgagatgggggtcttgctgtctggaagtatacatactgagaaattttatttttcaaacaaaatcaccccttttcctgtcttaggactggacattgcatctagttgtcggatctccttaagcctttttctggtctgggaagcaactcagcccttccttgttttttataaccttggtaagtcatggaatgtccctcaattagggcttatctggaattcttcatggtgagcctggggtgtgagttttggggaagaaggccattggtgaggtgcccctctcttctgtgaatctttttttgtttgtttgttttttgtttttgtttttttgagatggagtcttgctctgtcgcccaggctggagtgcagcggcgcgatctcagctcactgcaagctctgcctcctgggttcacgccattctcctgcctcagcctcccgagtagctgggattacaggctgccaccatgcccggctaatttttgtatttttttttagacggggtttcaccgtgttagccaggatggtctcgatctcctgacctcatgatctgcccgcctctgcctcccagagtgctgggattacaggcgtaagccacctcgtccagccatcttctgtgaatcttatcaggagtataggataccaacaagactgataaattattgacagtgataactgatgatgctgaccttgatctcttggctgaggtaggcttgctaggtttccccactggaaagttactagttttcttcttttcatactctatcctttgggatcatggaaaattttatttttattttatttttggagagtctcgctctgtcatctaggctggagtgcaatggtgtgatattggctcactgcgacctccgcctcccggattcaagcgattctcctgcctcagccgcttgagcagctgagactacaggcgcccaccaccacgcccggctaatttttttttttcaagagatggggtctcgctgtgttgctcaggctagtctcaaactcctagactcatgtaataatcctcttgcctctggctcccaaagtgctgggattacaggcattaaccactgtgcccggccttttctggcactattgaaaagaccatcctttctccctaaagttgcttttgtctggaattagttggccatatttgtgtgggtccaacctgaactgtctgttctgtgacgttgatgtatggctctgtcctttctccaaaaccacatatctttcttctctttttagatagagatgggggctgggcacagtggctgacgcctgtaatcctaacactttggaggcaggtggatcacttgaggtcaggagtttgaaactggcctggccaacatggtgaaactccgtctctactaaaaatacaaaaaaattagctgggcgtggtggtgggtgcctgtaatcccagctaattgggagactgaggcaggagaatcacttgaacacgggaggtggaggttgcagtgagccaagatcgcgctattgcactccagcctgggcaacagagtgagactctgtctcaaaaaaaaaaaaaaagaaaaaaagaaaaaaatagagatggggtctcacaatgttgcctaggctggtttcaaactactgggctggtgatgctcctgcctcagccttccacagtgctggcattatgggcgtgagccaccacgcccactcatttctatattgctgtagctttatagtaagacttgaaatcaggccatgtgagtcctcttttttcttgtttctcaaaattgttttgtctagtctagttcctttgcctccacatatatattttagaatcagcttgttgatttcatagaaaagatcattgtgtattagtacgtggaaagccacggtattagttttttgtttgtttgtttgtttgtttagacaaagtctctctctggcacccaggctggtgtgccaatagtgttgggattacaggcgtgaaccactgtgcccagctggtactggtttttataactgtgtattattccatccactgtcactacttccccaggaccagtacagtttctgcctcctcagtcttgcacctttaaccttgtcctcacccccaggctgttctccctgcagtggacagagggagcctgttaagaatatccttcctagctgggcgccgtggcttacgctgtaatcccagcactttgggaggccgaggtggaaggatctcttgagcccaggagtacgagaccagcctgggcaacataacgagacccccatctctacaaaacatttaaaaattagccaggcatggcagcgcatacttacagtcccagctactcaggaggctgaggtgggaggattgcttgaacccaggaatttgaggctgaagtgagctgtgatcctgtcagtgcactccagccggggagacagagggagaccctatatccttcctctacttggaatcctccctggccctcagttccctcagggtaaaaatgaagtcgtccctgaggctccatgatgttctcatgcaggtgaggcgctgtcctacctcatggctttttcacatgctgcttccactgcctgcactgcccttcccccagataaccctgtggctcatttcatcagcattctaaggcctctgcttaaaagcctccttctcaaaaggctctccccctggccactctgctcaaacgccccaccctgttctctctgtccccttcccctgcttaatttttcttggaaccacttgtcattcctgtcattgttccacctatgcgtttggtttcttgttttctttttttggggtggagtcttgctctgactcccaggctggagtggagtggcgatcttggctcactgcaacctctgcttcccgggttcaagcgattctcctgcctcagcctcccaagtagctgggattacaggcgcacgtcaacatgcccgtatatttttgtatttttagtagagacgaggtttcactatgttggccaggctgatctcgaactgctgacttcaggtgatctgccagccttggcctcccaaagtgctgtgattacaggcatgagccaccgcacccggcctatttgtttgatttctctttctgtctccccccactagaaggggaatgccccatggtagggcggtgcccctggctgtagcgcagtcccttgcatggtgcctggcatgcgataggtaatcggggcacccatctccctctcgggatgcactcattgatgtacttgtcaatcactgagcaagacccactcagcaatgtctgctgagcctgctctgtgccaggctctgacctgaactgccacccttctggagtcaaacaggcctggttgccaccaagaggagttaggcctggcagaggagacaagcattagtctcacaacagaaggaagtaggccggacgtggtggctcatgcttgtaatcccagcactttggaaggccgaggtgggcagatcatctgaggctgggaggtggaggttgcagtgagccaagatcacgccgctgtactccagcttgggtgaaagagcgagactccatctcaaaaaataaataaataaataaataaataaaaaggaagtggagactttcattgagatcagtatcaaagggcacgaggtggcagggcatggtggctcacgcccatagacccagcactttgggaggctgaggtgggaggattgcttgagcccaggagtttgataccagcctgggcaatatagtgagacctcatgtcaacaaaaacagacaaaacaaaaaaaacaggggagggagggctacaggagggtgggatgaggactggccacagttggaggccaggcccttcctggggatcccagcggttgttactctttaagaaggacctggcctggtgtggtggctcacgcctgtgatcccagcactttgggaggttgaggcgggtggatcacttgaggtcaggagttgaagaccatcctggccaacatggcaaaaccccatctctatgaaaaatacaaaaaaaagttagttagctgggcgtggtggtgggtgcctgtaatcccagctacttgggaggctaaggcaggagaagtgcctgaacccaggaggcagaggttgctgtgagctgagatcgcaccgttgcactccagcctgggcaacaagagcaaaactccatcgcaaaaaaaaaaaaaaaaggctgggctcagtgactcacgcctgtaatcccagcactttgggaggccgaggtgggcggatcacgaggtcaggagattgagaccatcctggctaacacggtgaaaccccgtctctactaaaaatacaaaagattagcggggcgtggtagcgggcgcctgtactgtagtcccagctactcaggaggctgaggcaggagaatggcttgaatcctggaggaggagcttgcagtgagccgagatcacgccactgcactccagcctgggcgacagagcgagactccgtctcaaaaataaataaataaataaaagaaggacgtgttcccttgttcttctatggggacatggggaactcctgtactgttttattttcctgaaatatttttattgaaatataattcacataccataatacctaatccttttgaaatatactattcagtggattttagtatattcacagttgtgtaaccagcaccactatctgattttgtagcactttcatttcccctaaacccatacatatgaagcagttcctccctcccccagcacctggaagccactaatgtcctttctgtctgtgaatttgccaattttggatatttcctataaatggaatcttacagtatatggccttttgtgtgtggctttgtttatttagcatcatgttttcaagattcatccatgctggttgggtgcagtggcgcacgcctgtaatcccagcatttgggaggctgaggcgggcagatcacttgagggcaggaattgatgagaccagcctgcccaacatggtgaaaccccttctctactaaaaatacaaaaattagctgggtgtagtggcacatgcctgtaattccagctactctgggtggctgaggcacgagaatctcttgaacctggggggcaaggttgcagtgagccgagatcactccactgcactctagcctgggcaacagagcaagactctctctctctctcaaaaaaaaaaaaaaaaaaaaaaaaaagaattcaccaatgaagccacctgggcctggacttttctttgtgggacgttttttgaatactaattaaatttcttgtacatctattgagtttttctgtgtcttcttgagtcagtttcagtaatttgggtctttctaggaatttgtccatttcatctagggtgtatttaatttgttagaatagtattcccttatcatcttttttatttctgaaaggttggtagtgatgtctcctctttatttctgatttttgtaatttgagtcttatctctttttctcttggttaatctagctaaaggtttgtcagtttggttgatctattcaaagagcaaattgtggtggtgttaacttctctctccatttttttagtctctttatttcttctctaattatttccttcttttctctttggatttggtttaccctccttttctgaggttcttgaagtggaagattattgaaatctgaaagtatttgaaatctttctcttttttttgttttttttttttgagacggagtctcgctctgtcgcccaggctggagtgcagtggcacgatcttggctcactgcaagctccgcctcccaggttcacgccatcctcgtgcctcagcctcctgagtagctgggactacaggcacccaccaccatgcctggctaatttttgtatttttggtggagacggggtttcaccatgttggtgaggctggtctcaaactcctgacctcaggtgatccacccacctcggcctcttaaaagtgtggggattacaggcgtaagccaccgcgcccggccaaaatcttccttctttttaaatacagttgcttacatctatgaatttccctgtaaacctgctttagctgcatccataagttttgatatgttgtgttttcattttcatttatctcagcatatcttctcatttctcttatgatttcttctttgatacataggttatttagcagtatgttcatttctatatatttgagaatttctgaaaaacatctttcttgtgttcatttctaacttcatttcactgtggttggaggaactactttgtatgatttcaatctctttaaaattattgagtcatgttttatggcttggcctcgaatacggtgtgtcctggagaatgttccatatgcacatgataagaatgtgtattttactcttgggtggagtgttctgtacacatctgtcaggtcttattggtttcgtattttctatttccttgttatcttttatttggttgttccatccattattattatttttcttgcctgataccaatgctgatatccatccatgattgaaagtggggtattgaagtctccaactttctttctttcttttttcttttctttttggagacacggtcttgctctgtctcccaggctggaaacgtggtggcatgatcatagctcactgtagcttctgtctcctgggctcacatgatcctcccacctctgcctcccgagtagctgggaccacaggcgtgtgccacacccgactaatttttgtattttttctagaggtagggtcttgctatattgaccaggctggccttgaactcttgggctcaagtgatcctctcatcttggcctcccaaagtgctgagattacaggcatgagccactgtgctcagccccaaattggccaatatttctttcttttttttttttttttgagacagagtcttgctctgtcgcccaggctggagtgcagtggcgcgatcttggctcactgcaagctccgcctcccgggttcacgccattctcctgcctcagcctcccaagtagctgggagtacaggtgtccgccaccatgcccggctaattttttttgtatttttagtagagacggggtttcaccgtgttagccaggatggtctctatctcctgaccttgtgatccacccgcctctgcctcccaaagtgctgggattacaggcgtgagccaccacgcctggccaatatttcttttgttctgtgctttttccttcctccctcccttcctctttaccttcctctttaccttcctctttccctccctcccttctttccttccttccttcctttttgttcttgttcttttctttttcctctacccttctttcttttccttctttctttttttctttctttgtttttgcttgattgcagcatcatgagagagtcctgtgcttttttatagctgcaagtattcctgggtcgagcctactcccactaacactgatcactctcccccttgaatttttaggttatttctagtttttcccctcctgccagagacttgggggtccgcaggcttgtgtgtctgctatgctcagggtggataccctgcaagggagtgccatgttgcatcagaagtggatttagagtgatgttgccaggcccaccaggaaaggctgtgccaaggctctttgctggggtgccaagaagaagggtctgtgcctgttgtggtgccaggcattgacatccttcactcccacccccgtcaccctcatgaactagtgaactagtcctgtggaatagggccttatgcgtgctagaccctgggtttgtcctgctgacaaccccatagtgtaggtgctgttatcccaatttcatagagaaactgagggctggggaagtggcagccttcattcagttcctgccgtgaggctgtggctgagctgccaggctgcagagtcttcacccaatgatcttgctcagttgtccccatgaggaagctgagcctggccttcctgtctctggagtccaaggtttcctttccttgtgtgcccctggaagtgctgtgtggtgaccgggatggtgcctggcagatggagattagacgcaggttggattggtgcctcattggtcaggagggctgctcttagctgtgtgccaatagaccggatgacttaatctctctatccttggtttccccatctgcaaaacagggttggccagagccctgtgaaggtggaagaaggccctgtgtgcctggagctttgtgcagtgccctggagatgctagcttgtttttctttcttttttttttttttttttgagacagagtctccctctgtcatgcaggttgtggtgcagtggctcagtctccgctgactgcagcctcaacctcctgggctcaagtgatcctcccacctcagcctctcaagtagctgggaccacaggcgtgtgccaccacgcccggctaattttttgtagaggcgaggtttcatcatgttgcccaggctggtcttgaactcctgagctcaggtgttccgcctgccatggcctcccaaaatactaggattacaggtgtgagccaccacgcccggccgtgatgccagcttcttttgccgtgcagctagcatttgctgaacacctgctgtgtgccagatagtgtgctggaggcagggcagtgaacaagacagacgagatccctgtcctgtggagctgatgctctagctgggggcctgaggggtgggaaggaagcacaggtgctcgggtgagaaaaaacatcatgcggccaggcatggtggctcacacctgtaatcccagatctttgggaggctgaggcaggcggatcatctgaggtcatgagttcgagaccagccttgcaaaaccccgtctctactaaaaatacaaaaattagccaggtgtggctgggtgtggtggctcacacctgtaatcccagcactttgggaggcggaggcaggtggatcacaaggtcaggagatcgagaccatcctggctaatatggtaaaactccgtctctactaaaaatacaaaaaattagccgggtgtggtggcgggtgcttgtagtcccagctactcaggaggctgaggcaggaggatggcatgaacccgggaggcggagcttgcagtgagccgagattgcgccactgcactccagcctgggtgacaaagcgagactctgtctcaaaaaaaaaaaaaaaaaaaaaaaaaaaattagccgtgtgtggtggcgtgcgcctgtagtcccagctacttgggaggctgaggcagcagaattgcttgaactcgggaggcaaggttgcagtgagccaagatcacgccattgcactccagccagggcagcagagcgagactgtttccagaaaaaaaaaaaaaatacaaaaattagccagacgtggtagcatacgcccgtagtcccagctgcttaggaggctgaggcaggaaaatcacttgagcccaggaggcggaggttgcaatgagccaagatcctgccactacacttcggctggggtgacagagccagactccatctaaaaaaaaaaaaaattctttaaaaatcaggcacacagtgtgatctgacttgcagttttccaagcctgtggggcagggagcctgggggaggctttgccctgagatgggagacttggcctcaggacattagagcgaaacagaggaggaggggatgggtctggatatccaaggcaggatctgccgagagatacgctgtgggggtgggacaaagacctcaagaacgggtccgggctgttcctgtcacttgtgacattgtggactgagtctgcctggatatttccttatgggctggctccccatcaccccgggagagtctcggggtggagggaactagaacgtgtttgcctggaggtcactacctactcccctggaaggaaggggctccaggaggctggctgtggaatgcagactgtgggtggtgcccggctgcctgcctctagttcacttgggccctcagggtggtacagagctggaaatccatacatggctgaccaccctgtaagggctgcagacacagtgagcgttcactttgccctggcaactggaactgtctcctccagtcctcaccacaaccgttttacagagcaggacacctgttgcaagatgggagagactttgctaacaaggtcccacagctggcactcaccaggctggctggggtactcaggccaccccttgcagtggggagcagttaggatgacaccgaggacacccctaggagggcggagttgtgagctccaggaccccacatttgagcagtttccccgtcactcttgaaaatgctgctgggccggccagtttctttggggtttctcagtactgctgaaagttacaaggtcaacactggcctgcaatcacagttataaaaaagttataaaagcctgacattcaaatcacgttggagactataaaacagcaagtttttcatttgcacacctcacatgacctcaagcctgctgtccatacacaggaaatggggatgtgcggaaaaaaaacccgaagtggaggacatcatcccccacgcataatccagtccgtgcatcgcacttgaccttcggcactgcagcctgcattgctccccggactagctcccaagattgatttagccagttccctgccagtggacatttaggtcattatcggttttcattccacaaagtactgccctcagggagtcggctgtccttgccaaaccactgcattaatatgtttctgggtgctggggaaagggcgcttaagacccctgccctcaaggtgttgatattctagttgggactgttagataaatgagcaattaggctgggcacgcttgaaatcccagggctttgggaggctgaggtgggaggatcgcctaggcagcatatcactacagaaaaacacaaataaaaaaagttagctgggcgtggtggcaagtgcctgtagtccgagctactcaggaggctgagggaggaggatcgcttcagcccaggagtttgaggctgcagtcagctatgattgcatcactgcactccagcctggatgacagagtgagatcctgtctctgaaaaaagaggtgcaaataaaccagaaaagtaccaactagtgggcagtgctgtgtttagaaggaaaacagggcaacatgaaggggaggtgggcatcagtaggggacagacctctctgaggaggtgacatctgagttgagtccctggtaaccggagatagccaggattgtggaaatacttggaggagatgagatggtctttcgaagcaggaggccagcatgtgcaaaggccctgcgacagcaatgtctggcctccttgctgtttctttttatttcattttttgagacggagtctcactctgacctatgctggagtgcagtggcatgatcttggctcactgcaacctctgcctcccaggttcaagcgattctcgtgcctcagcctcctgagcagctaggagtacaggcacacgccaccacaccccactaatttttctgtatttttagtagagacaaggtttcaccatgttggccaggctgctctcgaactctggacctcaggtgatccacccacctcggccttccaaagtgctggcattacaggtgtgagctaccacgcccggcctttttgctgtttcttgaccaccaatgtggctggaggcagggagtgagggggtggtgggggaggagggcacggaggtgacagggccatggggggcacttgggaactgtcaaaccgtcaaatgttatgagcagaggagggtcatgttcttacattgtatcgagttttcctttttgtttttttgagatggagtttcactcttattgcccaggcaggagtgtaatggtgtgatcttggctgactgtaacctctgcctcccaggttcaagcgattctcccacctcagcctcccgagtagctgagattacaggcatgcaccacacctggctaattttgtatttttagtagagacggggtttctccctgttggtcaggctggtctcgaactcccaacctcaggtgatctacctgcctcggtctcccaaagtgccgggattacaggtgtgagcaaccgtgccggctttttttttgttttttgttttttttttttttgagacagtctcactctgttgcccaggctggagtgcaatggcatgatctcacaatctcagctcactgtgacctctgcctcctgggttcaagcggttttcctgcctcagcctctcgagtagctgggattacaggtgcccaccaccacgcctggctaatttttgtatttttagtagagacggagtttctccatgttggccaagctggtctcaaactcctgacctcgggtgatctgcccgcctcggccccgcaaagtgctgagattacaggcatgagccaccgcactcaaccaattttttttttttttttagtagtagagacagggtctcatcatgttgcccaggctggtttcaaactcctgggctcaagagattgcgtgccaaggtgctgggattataggcacgaaccactgtgctcagcctgagttttactttgattcgatggggcgaatgttctcttttgggtatcatggtaagagtttcacaaacccttccacctcctctctgaggcaggtggcatcattcccacataacagattgggaaactgaggcacaaagaggttacctgacctgcccatcttgtccagaaaggaaatactggattccagccagggcctggagagtcccagagccacgatcacgaattgccacaggtcacctcctgcttttgctcccagcctgttgtgtcccttggatgagaccagggagcaggtgatgccacggcttgagtgccaagggcgggcctcgagccgggagctgcaggattcctgatcagggaggggctgctgggctgggaatgttggggaggagtgaggccaggagtggattgtggaagtgagaagtctcctcatctgtaaaatggcagatttggcccattgttctgcaagcattggtcatctgcctcctgcctgggtgtgtgttgggtactggggagagagcagagaaggggccgatacgggaccctgcgcccatgaggctgccactctaataggatgttgaggtgggggcagggacagactgcagctgggtgaacacatcaggaacccggaagatgccagttgtgagtggcactgagcattgagcgggttgatgtgtgaaagaaggggagcagcttcctatggcggggggagggagggtgcagtttgctgggagctgcccgcctgctctgttaatgctgcaggaagaaggttccaggctgagggaacagcctgggcaaaggccctggggcaggacagtgtctggtgtgtttcgggaacatggaggaggcatatgtggctggagtaaagccagcaagacagagagtagggggaggtgaggacaggaaggtgacaggacaggtcgtgcagggcttggggggctgcagggaaaagtctggcttttattccaagtgaagcgggagcccaaggagggcccataacaaaggggtttacagtgacatggtgtgcacaggcaccttgtggctgctttgtgggaggcagattgtggggaccaagggcacgactgcactggtgtaggcaggtgacagtgggacacgctgacagccttggacgtggagggaattgagcagaatcaggcctgatgtggaggtgaaaccagcaggactcgcggctggacaaggcgggtgggtgagggccaggggagccccaggtctgcagcctcgtgaggggtttctcccctccctgccctttggggtgaccacagggatgcagtggcacctacctgcggacactgtgtgggccgagcactgtaaggcttgggcgtccttgctgggtgaccaatggctattgttggaaggatgaggcagggaccgaggtgggcagaggagactgggcatgggtccccacttctgctccaacagagcgacagagaagcccctgaggtgggtgcgggtgactgcgggtctgcctcattggtgtcccacccacattcgtgtcctggctctgctcctccctcgctgagcgtcctgggcaagtcctgagactgaacctcagtccacctgtctgaaatgggacttttggccctggcatccttgtgactttcaacccctctggggttgtcagaggatttgccgctatgttgcccgagatggggttagagacagcctgttgggtggccagcgttccttgtgtggctcttatcagagtcctgagagaagaggccagggtggaaattggccctggagtgtgggctcctgccgaagcctcttcctgtggccagtgccatgctgaaggctggctgtggtgtcacgtgagccctcccagccacattcaggctcaaagagactgtgctgagcatatggtgacaaggaagggatcccagcccagggtcctggccaggccctgccagcaccaggctgcacaggtgaggggtggcttgccctggggtgctggctctgggccacactgctgactcaccctctgtgggcttatctgttgattctccctcccatgggaaggctctgggtttgagcctgcatcgttcctgcacgtagccgtccccaccctcataggggctggaagtcaaaaggcgcctggtggagccttgtggtctgttcaaaaaacggtaaataaacagcctgggcttctgatctgctggactcaacctggcacctctcccatcgctgctgggtgctgcctcccagctgcacccttccctgcctgtcccctaccgccttcctggagcgcttatccccttccagggagaggtggcccactttagagctctgaaacctgctctggtggggtgaagtgacttgagccaggccaagccggtggctgggccctctgtggcagactggaagtgtcctcccatttcatggatggccaagtcagtgcccagagaggggtagagacctgtccagggccacacagcccaggaggggcggagctcgactttgaacccaggctgcctggctccacagtctggattcttcttacccattcaacaaatacttaatgagcacacactgtctggcaggcactgttctaggtgctgaggatctagcagtgaccaggccaggtgcagaagtcttggcgtgtcacaggactagaccttcatcagaggccgttttgctgggagtgggaaggggtgtgtatttgggagggaggggcgcaagccatcacacctgcccatggccaggtaggcagggcctatgggagggtttcctggcagagggaacaccccctgcaaaggcctgaaggccagcagtgccagagagaactcagaggaggcaggtgcagggggtggggctggggaacccggtcagcactgggactaggactggacaggacgggctaggaccagtcacttggtttctgcaagagagaagcttggaggcaggatcttcattttagaaaggtcactggggaaggtgggaggttgggccaggaccctggggcctggcctgggcccatggataggaggccaggtactgaaatgatgcaatagtactaggctaggtgcagtggctcacacctgtaatcccggtgctttgggaggccgatgcgggaagattgcatgaggccagaagtttgagaccagcctgggcaacatagcgagaccctgtctctgcaaaaaataaaaaaattagccgggcatggtggtgtgtgcctgcagtcccagttacttgggaggctgaggtgggaagttcactagggtccgggagttcaaggctgcagtgaggtatgattgtgccactgcactccagactgggcaatataggaagatgccatctctaaaaaaaaaaaattagccaagcatggtgacatatacctgtagtcatagctactcaggaggccgagactgaggtttgcctgtaccctggagtttgaggctgcagtaagctgtgattgtgctgctgatgcagcctgggcacagagtgagatcctgcctctaaaataaataaggccgggcgcggtggctcatgcctgtaatcccagcactttgggctgctgaggcaggtggatcacctgaggccaggagttcgagaccagcctggccaaaatggcaaaaccccatctctactaaaaatacaaagaaattagccgggtgtggtgctgggcgcctgtaatcccagctacttggggggctgaggcaggagtaagctgagattgcgccactacactccagcctgggtgacaaagcaagactccatctcaaaaaaaaaaaaagttaataaactacttaattgtgcatctcctgtgtgccagccctactctatgctttggggatggaatgttggaggatcccaccttggggagctgtgtgtgagctccccacacagctcagatgggggtatggggtctgtatgtgagccagaacaaaatgcagctaagtgacatttagcatgtgttagttccacagagaaaaatgaggcatggggggtggaggtgggagaggtgtgaatgggggtgagagaagtctctgaggaaatgtcattcgagcggaatcactctgagcttggcaaggttaccctgtcttactgacgggaaacctagaccagagaggccaggaagcccgcccaggatcacacagcacagaggtggccaagcagggactggaatgcagggcagcctgggtgcacagagggcactgtagcagcagcaaagggagaggagaggagtaggtagatttcagtactctcagaatgcggatgggatcaacgaggaggaagtagatgacggaggctggaaagtcacttcctgctaagtggccagtgtcagtgttccaggcagagctgcttgggaggtggtttctggaaggctccaagtactcctgctgctgtgtcccagaaaacccttagggccaggcccctgctcaccaagctcctaggagacttctggggggctcatttcggaggcagtccaggccgagggtgaatgttggtgccctttgcatgcagcagtctgggaacttttagaagcaaaatcggataagtcccagggctcctggcgctctcagcctggcatgcgaggccctctgcgcctgccctgccctgtcctcaaactctcccctgagagctgcgtctccgtcgcccaggctgtgccctcctgtgcccgacttagaactgttcggaataacactcaaaattttaaggaaattaaacactcgaacaaaggatttttagcaaagcaattttacttctgtacagaggggtgcttgtccttggccagtcgccatgagagcacacctgaacaaagggacacgagagcctttattcctgatgcaagtcctgctcctgtaccctctccccattggccggggtcgggtcatacaatctaaaccaattttggttggctaaacatttgaatttttgtagataaggtgggcacgtaaaagagagaggaaaggggaagggatgtctgtagtgaactagaaagttagtcttctttgtaaataagggaaggaatgtgagctggtactggtaacgcctggtactgtggcgtgcctgggcatctaacaaagccagaaaggaaaaaggaaaaaagagtgtgtatgtgtgtgtggggtactatgaattaaaagattgatcagcctgtttgaagagaaacctcatcatattccacactacaaataccccaggcccagaaagtcaccttctcctgcctgtgcccacagctctgtgttctcttgggcgtcactcccgccctatgttctgaagctgtgattgtccgttgtctgagctgggcgctggtggcgtctggggcatcaccattgtcctcacagtgcctggcgcctcagacacaaagtggagtcacaggacagcacaggccacaggcaaacaccagaggtccaaagccgggccctggctgggagttactggagggtctgcctaagatgtgtttgctcagaaggccaggtgccctggtggttagacagctcaggccctgtgccttcagtccatgttcatgccacccccagatgctgtgtgaccctgggcaggcccccaccctctgggcctcatttgcatctgtaaaatggagccagcagacccattttaatggatcctgtcatggttaaatgggttaataggcaggtgcagtggggtcattgcagggagttcaagaccagcctggacaccatagtgagaccttgcctctacaagaaacttaaggtggcctggtgtggtggctcacgcctgtaatcccagcactttggactccattgcactccagcctgggtgacacagtgagactctgtctgttaaagaaacaaacaaacaaaaaaaccaaaaaacttaaggtggtggtgggtacctgtgatcccagctacttgggaggctgagacgggaggatcacttgagccctacagttggaggttgtagtgagctgtgaccttaccactgcactccagccagggcagcagagtgagaccctgtctctatttaaaaagaaatcaaaaaggttaataatcatgaaaagttctcaatgccttgcttggcatagagtcagtgttgaatagctattagctactctaatgttttgaactcagtaatgcgtgtgtatgatgcggaattcaaagatgtcggaaaacatgcagtggctccttccccaccaggccccagccgccccgggtcctgttttgtttccctttggttgtcttagtcacaaagtacagactttcttctgtaccttttccttccccttcccccctcccccttcccttcccccccccacttccctttccccttcccccttccctttcccttttccttctcttcttcctttccttttctttcttcagtaaaactgatcactacaaaccttttctttttttctcacttagtacaccaaaaagggagttacatgtctagaaaggacaggctctttttgtgtgtctgttgctgcatagcagcatggataggccataatttatatataaatacacgtattttattctattttaaaggtttttgttttgtttttttcccccgagacggagtttcgctctttgttgtgcaagctggtgcaatggcgcgatctcagctcattccaacctctgcctcctgggttcaagcgattctcctgtctcagcctcctgagtagctggcattaaaggcacccaccaccacgcctggctaatttttgtaattttagtagagatggggttgcaccatgttggccaagcaggtctcgaactcctgacctcaaacgatccacccacctcggcctctgaaagtgtttggattacaggcgtgagccattatgcccagcaatatatcttatatataaggtgattgaaaatatatgttttcaaaaagaaaacatattttcagtcagcttccttaggttgaacgtaatttatatttaactagtcccctgttgctgggctttaaaattctttgagatctgaatttttcgtcttattgagaaactaacagggttgtaacaattctgtgggcaaattttaatggaatgtccaccctgtacttttgtatctgaatcttcacgaacatgttctccttgacttgtgaccttttcctgagatttcagttagatatagttaatcgcttaagtctttttttttttttttgagacggagtctcactctgttgccaggctggagtgcagtggcgctatctcagctcactgcagcctccgcctcccaggttcaagcgattctgcctcagcctcctgagtagctgggactacaggcaccctccacctcgcctggctaattttttgtattttagtagagacggggttttaccgtgttggccaggatggtcttgatctgctgacctcataatctgcccgcctcagcctcccaaagtgctgggattataggcgtgacccactacaactggccaatcgcataaatcttaaacatataccttgattttcttgtcttcttcttcttcttttttggagacagtctccctctgttgcccaggctggagtgcaacggcgcaatcatggctcactgcagcctcagtctcctgggctcaagtaatcctcctgccacagcctcccgagtagctgacactacaggggaatgccaccatccgcagtgaattactttttactttttgtagagacaggggctcgttatgttgcccaggctggtctcgaactcctgacttcaagtgatccacccaccttggcctcccaaagtgctgggattacaggtgtgagccactgctgcaagttttgattttctaataaatgattgtaccttggtacctactggctagatcaagatgcaggacttcttcatggtctcagaaagtccctcctgccccttctagtccatttcccgaaagggaaccactgccctgatttctatctccagagactagctttgccggttcaagttcaagtccaccctgtgactcagcaagagaaacaaggacatgtgtctacaaaaagcgcatatgagaatgttcagaacagctttatttgtaataaattcaagctaggaagaccccaaatgtccatccaatggtgactagacgaacagactgtagtccatcagtgcaatggacagattcgaccacgaaaaggaatgaacgtcagacacacgaagcagacaggatgtctgtgattgcatcacatgctgctcctgtgttgttttatcgttgacatcttccacttgcacacttcaaaaatagtcattgaaaggatggagcaggggcactgttgtgaggggcacgtgctgtcaccgccgctgctggtgattcagtgtctagccagcgccgcatggtttctgagatgctgcatttgtcttttttttttttttgagacagagtcgttctgtcacccaggctggagtgcagtggcgcgatctcagctcactgcaacctctgccttccaagttcaagcggttctcctgcctcagcctcccaagtggttgcgattacaggtgtccaccaccacacccggccagggtttttttttgtctttttttttttgtattttgtattgtttttgtttttgttttgagatggagtctcactctgtcacccaggctggagtgcagtgatgcgatctcggctcactacaatctccgcctcccgggttcaagccattctcgtgtcttagcctcccgagtggctgggattacatgcttgcgcccccacacccggttaatttttgtatcttaagtaaaggcggggtttcaccatgttggccaggctggtctcaaactcctgacctcaggtgacccacccaccttggcttcccaaagtgctgggattataggcgtgagccactgtgcctgacctgagacactgcgtctctgatgtgcaagatgccaagtgtccctgcccctcaggtccctacctgtgagctaggtggcctggggctctggtagggccagggccaaggctacttgtggcgttcatgaggttaataccctgggacagcctggtgtccactgtgactactgtgacggaaagacaaggggccatgctaagaggtgactttggggtctgtcacctgcatgggggcgcccgctcgctgtttccctcgttcagttcactccgcctcccaattgatgtagcttgttccctcagtccccctgctcagagaaccctctccaattatcccagcccccaacccctctcacccctgcagtatgtcttcctcgcacccacccccgtcagaatgttggcgccagtgtcaccagcacctccccaagtgctcaggagccagtgagaaaggttcgctccttttcatgcaagccatgagctgtgatgttgtccaagtctcgtatcctgtttgtgcctcaggctcctcatcagccgaatgggaggctgacggaaagggattagagctcaggcatcagcttgaactggggcacgtggcgtgacaggcctagtgcctggcaggcaggtccctcgggctctttgtcatcctcaggagtgtggctcgaagacaggtagcatcccaggcctggagagctgactgtgctgcctgtggctgcagagacaggatgcagaggccagggctcgtcccccagagccttgcaagtgtctgtagggcgctcccctctgtcttgcctcctcccactctctggctcttctctatccggcctgccctcaggttgtgaccatccacctcccaaactgccctggaatctgcctacggcctgtccactggcctccgtacccctgcctgccatctctctggtttcgcccctgatgtcactcacatgaaccacagcggtcacccccacctgcctcctgctcctgccctctcctctgccctgcatcagccagaggggggtttaaaagcttacatttgttaataatctggctaaagcttaacatttattgtaatccatccctaaatcccagctggtggcattgctctaacagtgatgaccagcctcctcatcataatccccagcactgccaccctcaaccccccagcgctgaccactggaggctgcttctaaaacttcagccctgctctgccagcagcgcccctggggggtcttcgtagccctgttgcccatcacgatcccttttctcatgcagtccaggctgcaagcccccgccgagggcttgggctgacttgttgtgtagtcagtgctgtgtctctgcacccagccagaagtggtgggacagccccccggctgacgggctagaacccatcatccagggtgtgtggaaagagcacatctcccccccgacgccagccactgggtaatacattcccaggaatttccagtgcccagccccagctgagaaacaggtcttctggaaccctccagcaccctcatcaggggttcccagcatgggtagggccacctgccagctgggaatgattgtagtgctagtgacactcactcagggacccaggatgctgtctcgttctgtacagggcacagctgtacagtaccaattgccctgtgtcctgtacaaattttcaacgatccaaacatctaggtgcaaaacctgtttgaaattctctgtgttggccaggcacggtggctcacacctgtaaacccagcactttgggaggccaaggcgggcagatcacctgaggttgagttcgagaccactctggccaacatagtgaaaccctgtctctactaaaaatacaaaaaaattagccaggcatggtagcgcgtgcatgtaatcccagctactcaggaggctgaggcaggagaatcgcttgaacccgaggcagaggttgcagtgagttgagatcgagccactgcactccagcctgggcaacaagagcgaagctctgtctcaaaaaaaaaaaaaaaaaaaaaagaaaaagaaattccctgtgcctagaacctttcaccattttgtatgaaacaacagaatttcctttcgagcctttaatgtaccccgagcccactgtttctacttcagtcctcactggaaagctttcattttcctttctgagtgtacagggtgacttcctgtcttcctccttgctggaatcctggtgtattcactgtaagtcggagcaggctactccctctatcttctggggtggttgtgcctgagtcttttccattgtgaaagacatggaattgattcctttcttccttccctccttccttccctccttccttccctccctccttccttccctccctccttccctccctccttccttccctccctccttccttccctccttccttccctccctccttccttccctccctccttccctccctccttccttccctccttccttccctccttccttccctccctccttccctccctccctccttccttccctccctccttccttccctccctccttccttccctccctccttccttccttcctccctttcctccctttcctcccttccctcccctccctcccttccctcccttcccttctttccttgatggagtcttgctctgtcgcccaggctggagtgcagtggcacgatctcagctcactgcaacctccgcctcctgggttcaagcgattctcctgcctcagcctcctgagtagctgggattacaggcgtgtgccaccacacttggataatttttgtatttttagtagagacggggtttcgccatgttggccaggctggtctcaaactcctgacctcaagtgatccgcccacctcggcctccccaaagtgctgaggttacaggcctgtgccactgcacccggccaggatatgtacttttcttaaacagctctgtcgaatagtaatttacattccgcgaaatcgatccatttcagaattagtggtctttagtcattttacagtccttttttttttcccacacagagtctcgctctattgcctaagctggagtgcagtagtgcagtcatggctctgtacaacctcagcctcccgggctcatgccatcctcctctctcagcctctctagtagctgggatcacaggcgtgggccaccacgcccagctaattttagtttagtttagtttagtttagtttttgtagagatggggtcttactatcttgtccaggcttttacagttaattttagtaaacatcaccatagtccagatgtagaacattttcatcaccccagaaagctccttcccctccattggcagtcacccccgttcccacatccaggtatccactgatctgccttctgcttctgtagatgtgacttttctggacatgaaacacatcctattttgtcatcaataactttcctcgtattttacccatatacatgtggcattgtgttgatttaaaacacataggaaatgtgttgatctcctgggtatgggggaaatttaacaaatacatgccagggaatgggccccctgggagtacggggggtggggcacagcctgccagagggaaatggttctggtcactatgaccttccatgcataccttcctgagctcttcaggcctcaggaccctccaagaccagagcattccccagggcccagctggggttggtgcctttgctgaggtcgcccaaattgcaagacagagttgctccaccacatgtggtcacacttcctgcccctcgatccggacgcaagagtaatttctgtccctctccccccctcacagggacttccttccccgcggttcaggaatcgtcacccggcggcctctcattctgcagctcatcttctcaaaaacaggtaaaatggggcggcctgaggttcagcaggaagtggatgtggatgtgtggttgccaggagttgctgggggcggagggtggaacttgggtcctgggctgtcattggacattgaattcacgtgttccacatgtgtgaggaaattgaaaaacggctcagtgaacacttacacacccacactgcaagccctcagctgtgaccagaatgccaggtgccatgtgtgctttcttttttcttttttttgagacagagtctcactctgtcacccaggctggagtacagtgatgctatcttggctcactgcaacctccacctcccaggttccagcgattctcctgcctcagcctcccaagtagctgggattacaggtgtgaccctccatggccagctttttttttttttttgtatttttagtagagacagggtttcaccctgttggccaggctggtcttgaactcctgacctcaagtgaccctctcacttcggcctccctaagtgctgggattacgggcatgagccaccacaccggccccatgtgtgcttttcatgtgttatagataacccgattttgctgaacgctttcaaagtcagtagcagacgtggtgacacatccatccttcacgccccagtgcacctccccatgcaataaagacgcctgtctacaaagtcccagcaccatgccccagagaacgagtcattcccgcatgtcatccacgtcccagtttctactcagcatgtcgccagttgtcccccagatatctggctggttttatagctgctctgctcaatccaatgctatactcttttgtaatctcttcttctcttttcattaaagcagcctccccataatcactttttttattttttttaagagacagggtctcactctgttccccaggccgtgcagtggtgtagtcatagctcactgcggcctcgacctcctgggcccaagcaatcctctccaatcagcctctcgggtagctaggattacaggtgcacacaccaccacacccagctgatttttttttttttttttggtagagatgggggttatgttacccaggcaggtcttgaagtcctggcctcaagcaatcctcctgcgtcagcttcccacagtgctgggattataggcatgaaccatcacaccagccctctaccattgctttttattttttattttatttatttatttattttttgagacaaagtcttgctctgtcgccaggctggaatgcagtggcgtgatctcggctcactgcaacatccgcctcctgggttcaagcgattctccttcctcagcctcctgagttgctgggactacaggtgtgtgtcaccatgtctggctaatttttgtatttttagtagagatgggatttcaccatgttggccaggctggtcttgatctcttgacctcgtgatccgcccacttcggcctcccaaagtgttgggattacaggcgtgagccaccgcgcccggccaccattgctttttaatcagactttgactcttagggagacccagcctgttgaatatagtatggcctatgtgtggattttttcctgttctttccttccctgatctcagtgtatttctattcttcccacccgaggctgacatgaggtgggcgtatatcccagctggaaaccccctcgggcctccttgggaaggatcttgggtcagaagctagacccgggagaggtaagggtctccgtgccccttccctgctaatctgcaacatcagctctgggcgttcaacactcagtttgtgttaatgtcttcttgcggcccttttaaatactctcacactgggaaggcagctgacacacacacccccattctacagatggggaaactgaggcttagccatgctgcctgcctttccaatgggccccagatctgggacctgcatccaggcagatctgacctcaacgccagctctcagcttggcctcccaagactcctcactttcgtcctctggccccgcccaacctggcaagaaggcgtgtctccagtgagagacagcagccgatgggcccaccacctcttctttatgagctctgctatttcgtacgccaccgatgggccaatgggctgccacctctgggttcaggcgtccaatcagctgtgccaggaatgggcagccccaaagtcctgagagtcactatagaaatcagtgttggtagttttctgtttctcattgagcaggatggggacagatgtgcaaactgcatttttattttattttattttgagacggagtctcactctgccacccaagctggagtacagtggcgggtgatcttggctcactgccacctccgccttccaagttcaagcaattctcatgcctcagcctcctgagcatctacaggcatgagctaccacgcccggctaattttttgtgtttttagtagagacagagcttcaccatgttggccaggctggtctggaactcctgagctcaaatgatctgcccgcctctgcctcccaaagtgctgggattacaggcgtgagccactgggcccggccacaaactgcatttttaatgagtccctggtgatgctgccagtctctggccacaccactgggagagcctgccctgcttggtttaggcttggagcggagactgcccaggttcccaacccagctcctagggagggaccaccactgtgtttcctgtctggacagtgatgacaataacaccaccttgttagccttaaagcacacgttatttactacatgtcagggaggaggggagagaagcaggcagagagccttggccaggagggagcacagagcgcaggcctacccagtacctgacccggatgaacgatgatgggttcctgatgtctgtccccaccttacagaggagggagccaaggcttcctgaccacttgccttagggcacatgggaacattgtctttaaagcccacccttaagccacctcttgggggaatgtggccttaggccaaggtgtgacttgaccagatcctgtggctgttggtggaaaagggaccacaggggccagtgctgaggccagtgccctggaggaggcaggagtaggtgctggaaggggtgggggcaggtgggggatgggtgtggcagctgtggtggaggtggatgcatagttgcatcctgttgggctggttgaaaagggagttccagaagtgtcccacatgggtggggccttttcctgcctcccagcttgcacccctcagccccgcctgatcatggcattttcagtctctgtctccttttttgttttgttttgttttgttttgtttgagacaaggttctgctctgtggcccaggctagggtgcagtggcacgatctcggctcactgcaacctccacctcccaggttcaagcaattcttctgcctcagcctcccaaatagctgggactataggcgcacaccacctagcctggctaatttttgtatttttagtagagacggggttttaccatattggccaggctggtcttgaactcctggcctcaagtgatctgcccaccttggcctcccaaagggctgagattgcaggtatgagctaccgcgcctggcaaatttttaaattgagatgaagtcttgctatattgaccaggctggtcttgaactcctgggctcaagcaatcctcccatctcagcttcccaaaatgctgggatgacaggggtgagcccctgcgcccgaccaggctccaatctcttattgctccaagtaggtgcccacttggtgctgggccttagctgatctccagggaggcagcgtgagcacctggcatggtcccagcccccgagcccagcctgtgagtgtctgttggattcaccttggggttgggggcccagagagaacattctaggtagggaaacagcattagcaaagcagtgtggggaggtggtgaggcttgggaggggccagaaggcaggagggactgggactggaaggcatgttgaggattcaggcagtgggagctggggtggcatgcatggtggcgggagaccactggctgccatgttcaggagggacagtcagggaccagaatgcaagcggggagtgggggatagggagtggcagagaggctggcatggcgccaggcaagaggcaatgggggcctggccctggtggtgcgggcagatgccaggcagtctagactgtcttccaggcaaggcattaagcagcataggcacccttgctgggggaggtgggtgggaggtaggacgccttactaagaggagaggaaaatgaacacattgcgggcatcagtgattgctggggccggcggggccttgtggggtatacaccagaccacgtggctcctagggattggcagctggctctctgtgaccaaactcagaaccaggctgccaccctttactggcccgggacttgttaaagtgacttccctctctgtgccttggtagcttcatctgtaaaatgggggtgatggtggcgctgccatcgtggccatggcaccccattggctgtggtatgctgtctcttcctgtggggtctgatgtccaaagacagggcccccagggcgcagcccacgttcccctctggttcccgcagcttgccctcattccagccatccccagtgaaccataacttccagccatagaagtttaaacattacctaagaccataaccaccaggaagtttggtggcccatgagtgaaccctgccctcactgggaagcagccccgtaaactctgagtgcctgggactgttcctgtgtggaatgtgcacagtgaggccctgtgaaccacccctccccaccgcccttggccttgaactggcctttggtgtgctcaccggaaccaaggaagagatgtcaggacctggctccagggcttcccattggcctcagaatcaaatcgagcctccttctcaaggccttgtggcccttgccagtctctgggacctcacctcctcctggtccccagccactgcccccatccatctccctcctgattctcaggcccagcttgctggttcccactgcttggcctctgtgctcactgtgctgcctgcctggaacgccctgttccctacctgccactgtctgctgctcacccgcacctggtcacttgccgccttcgttccccggtccccggcagcacgagttatcctgttcttgttttttctttttcttttttttttttttttgagatggagtctcgctgtcgcccaggctggagtgcagtggcgccatctcagctcactgcaagctccgcctcccgggttcacaccatgctcctgtctcagcctccggcgtagctgggactacaggcgcccgccacctcgcccggctaatttttttgtatgcttagtagagacggggtttcaccgtgttagccaggatggtctcgatctcctgacctcgtgatccgcccacctcggcctcccaaagtgctgggattacaggcgtgagccaccacgcccggcctgttttttcttaatggactctctctgcgccagcacacgagaacaggcatgcagatcggctctgcccagcacagggcctggcgccgagcaggtgctccgcatgcacggccgagtgaacgagctcaaagggctggtgctgtgccccttcttgcctactgggcgggaagtgatgggggttactttaccaagcatcttcccctggtgagcctggtccatcactctgccattccatctgcagccttgtatctagagagcagaccaagctggcgtgcgtcaggctgtgggctggctgggatgcctgcccaggctgacaccttcccagtggcaatttgtcctggactgggagatatttgcgtattgcctcggattagagagaactcaagggctaaatgggcatgggaagtgttgtgtgctgtgcccacttcttggtctgctgaaggctctcaaaagtcctgcatgagtggatcctgcctgctggcgtggtagctagggtctcctgatggtggcagatccccaagttgttccccctggtcctgcctgccaacagcaggtttgggaaaggcagatctcctctccttgccttcagggccagcctcgtcattgtgttctttgctgggggaacggtgagaagatccagggcagagccccagtgtgcaaagcactgggaccctagcccagcccctgagggttccctgagactaacagctgagccgtgtttgtgctcctgatgggatttgatcgcagtcatatgggagccccggcactgggttctgtgtcattgcattttggggaaactgaggtgctgagagaagggtaggaacccggagctgggtgtcgctaggctgtgaaaccacgaggcaccccgaaaactctcctccctctctccctctcctcacctccccaaaccctgctgtcttttctgttgggctgaaggcaggtcttcccagcaggacctgggcatttcaaaattcttaagtagtgccagcgggcacgtgaccagtgtgctttgaagatagggagggccattctctgaccaagggccttcggtcactctggggctccacaagctcctttgaaacaggaggctccgaagacctccagggtctccaggccagaggtgactgtggcctctggcaaggggctgcttcttcatgtcccaggccccctgaccctgagaaggtggcagcttgcacctgtggctcccttctggggacacctcaaagggcctgaggtgcaggggattgactgtttagcacagtggggccccagttgggggttcctgggagtgatgtcctcctaggttagagcacagattcttttttcatggattttaattaagcagctgctgtatacgagatgctagggggaactgtgatcacaccaagtctctgctctctcagagctccagcttcagtaggggacacaggcttgggagggaggcagaacctctctctggaaaaacccgcaagtacaaccagtgggcccacagttaggaggccctgtggtgggcgaggacggctgactccctggccttggcagcgtgattgctggatgactgcccagattaatcctttactcctgctgtgtgccaggctgggtccctcagagtccccagggcctgatcacatgccagctgcgaacctctctgagggggcccgggctgaccctcctcccagggagccctcctggctcagggtgccgggtgacagtgggggtgtgtgtggagctatcaaaatgctttgcagtttgccgaggaattacaggaactggctttggtatctggaaatgcctgtctgcagagggtggctgtggggtgcagcttgatggcagggaccgggacaggcagagccaggggtggctcagtggcttgttggctgggcctcggctgctgctgctgtggacaagttgacagggaactcagtgttaaggcctctggctgattctttgggccagtggattgttaaaaaaaaaaaaaaaatcatctcatctccagcacttgagcgcatgcagcgttccagaggcccaggctaggccctccactctatttctctttttgtcattgttttgagacagggtctctggcctccccttgtcatccaggctggagtgcagtggcgtgatcacagctcactgcagcttcaacctcccaggctcaagcagtcctcccacctcagccacccgtgtagctggaactacaggcttgcgccaccacgcccagctaatttttaatttttttgtacatgtaggatcttgctatgttgcccaggctggcctccaatgattctcccacttcagcctcccaaagtgctggagttacaggcatgggccactgctctcggcctggtggaagcttttaaacctctattgggctgggcatgatggctcatgcctgtaatcccagcactttgggaggccgaggtgggcggatcacctgaggtctggagttcgagaccagcctggctaacatggtgaaacctcatctttactaaaaatatacaaattagccaggcgtggtggcatgcgcctataatcccagttacttgggaggccgaagtatgagaatagcttgaaccggggaggcagaggttgcagtgagccgagatttcactactgcactccagcctgggtgacagagcaagactcagtctcaaaacaaacaaacaaaaaacctctgttgacctggcattcagcatttactttcaccatgccagggagccctgtgaagaaaggcaggcagctgcggcagacctggtcggtgcctgggcctttttctctggtgtggttctgttgctcactgacccactagggaagaaacggttttctggcacctgctgtccatatccttcgcccacatggaggggttggccgacagcagaaggatcttggaggagagatcacaaagaacagcccctgctggccgggcgcggtggctcacacctgtaatcccagcactttgggaggccgaggcgggtagatcacgaggtcaggagatcgcgatcatcctggctaacacggtgaaaccatgtctccactaaaaatacaaaaaaattagctgggcgtggtggcgggcgcctgtcgtcccagctacttaggaggctaaggtaggagaatggcatgaacccaggaggcagagtttgcagtgagccgagattgcactactacactccagcctgggtgacagagcgagacttcgtctcaaaaaaaacaacaacaacaaaaaaaaacagcccctgtcttctctgatcccctgttggttcccagcctgcatgtgacaaccggggaaggtgccgtgctccaaagtctggcatgtgagtctggctgcctggttccagccccatctcgtgtctgcccctgactgggcggacttgggtggggcaggtggtccttcctgggcccgtttcctggtccttgcgttggggaatggcctgaggttccgggggaaccttttgcagctcagacacctagattcagcttgctggggaagcctgtggcagccgggcaggcagaacctccatttctcacctaacatgcgtgagtgtgcccttggggacacagcaatgaccaaggcagatgggcgtcccttccctggtggcatggacattcaaggtaaagctctctatattagatttcttctcaccctttgtcagatggtagtaagtgttatggggaaacgaaggcaggggaggagggggctgggtggagcagctgctgtggggagagagatctgcaggaggtggggatgctgtgtgacttgagagagtagcttgccctctctgggctcctgcctgtgtgtgctgggggaacgatggcgcccactgcccctggtgctgtctttgccacatcattccttggggacttctgcccaccagctgctcagaccgtagctgtgctggctatgctcttcctgtgcaggtattgactctgagtcctcatacagcctgttatgatgcgcattttacagatcagtagactgagacctgggcaggccctctgactacagactgagctcattactgcacacagcgtgctgccagtacatgctgggctctggggtgctggagccgcaggtcctggccccatcaatacaatccaaagtgagctggctctgatgaggaagaggccaagatgccccactcagggaagtcttcctgggagaggtggtagccaggcagacctgggagtaggaggaggtagggctgggctttgtagacaccacacttggtgggacagaggcctgctagggagagggcctgtgtccttgccaccagcccatcttccacgccatgtccccctgcactctttgaagggagatggtctcttttggggctaagctggggtcctggagccagaagagaactgagatttgctgtggggggttgggagctgttccatttttagtggctgctacaggaagagcggccgagtgtttccccttgtccctgcagaaggctggagtgtaactgtccttgggaactgggtcagctgatagcagggctgggggtgggggtggggatcctgaatcctccagcagatgtcctcattgccctgatctgggtggccagtgcctgtgctggacacggtcctcagtcatcggagcccactgagtctccccctgaccctgcagagaatttcaaagaggcgaagttccttccagtggcctcacaaaggctatctggcttaggagccattacctgaagccagaatttctgagttccaagtcccagctccatcacggaacttggcccaaggcccttaacccctctgggcctcagttttgtcatctttgaaatggggatcttagagatgcctacctgtcaagggacttgtgaggcgcaacgggaccacacgcagggcctggccagagtgccgtagtttcttcggttgccatgatgggacggtgaaactcctcacactcttctttctgccttgaagattctagacctggctgggtgttcatctccctttttgcctttgcttgaggcagtttatggcatggctgtgttattcacgtcgccaggtctcctcctggtggacgttgaggccattttcatttttttactcttaaaaacgacagggcagtgcgcatcttcgcatctccggggtgggtcaggtctctgacctctttgccagtgtgacttattacccctttctttctttgtttttctttttgagacagtgtcttgctctgtcgccaggctggaatgcagtggtgtgatcatagatcatagctcactgcaacctccagctcctggctcaaatgatcctcccacttcagccgatattaatccattttcatgctgctgataaagacgtatttgagaccgggcaatttacaaaagaaagaggtttaatggagttacagttccacacagctgggctggggaagccccacaatcatggcagaaggcaaggaggagcaagtcacatcttatacggatggcagctggcaaagagagtgagagagcttctgcagggaaactcctgtttttaaaaccatcagatctcgtgagacttattctctatcacgagaatagcacgggaaagacccacccccatgattcattgatctcccactgggtccctgctacaacacaagggaattatgggagctacaagatgagatttgggtggggacacagagccagaccatatcagcctcccaagtagctggaactacaggtgtgcgccaacatgcctggctaattttttaaatttctgtagagacggggtctcactgtgtcacccaggccggtcttgaactcctgggctcaagtgatccaccctcctcggcgtcccacagtgctggataataggcgtgagccactgtgcccagccatttcccccttatttttagcatcactacagtagctgtgatctctgagctttggggatatcccctccccaacattttactctgaaaattcgaacatctggaaacgtcaaggctttgtacagtggacacctgtgtactcggcagccaccttccgtgatgaacatgccttatatttgctttgtcctcaatctgtgattcgggactggatttctcttgtttcctggtgggacccacactgcttgtcaattacttattttgttccccttcatcccagtcttgctgtgactttcagatacccccgggtcttatatacactcagggttatacccagaaaacatttctcctgggggatttgtctctaggtagggggccctcttgaatagtcagggggagaaagaaagactcaagaccagctctgaggaggcggcaggggtgccccttccctctaccttgtgggctccttggggaagaaggacaagtgagtgccatgagaaatacccctggggattttgtggagctggaatgtgctggtggaccatgaatccacaaggacttgggcatcgaactcccttgactgggacccacagcaagggaggctctgcagcatcaccttaatcaaatggactcaccctctctgggtgatgtatcctggtgcttcctcttctgttcatcagtcaatcaacaaataaatggctgggcgtggaggcatatgcctgtaatcccagaaactttggtcattggttatgtctacctgtttatttttgggggagggggattcataatatgtcatgacgtatattaacagtttgcaaagtgccacatgggaacgtaatcttcaggatctggaaagaggctcagtctattcagtctataggaacccccgcctcccccaagacccttgtcatgagaacgaatctttcactcccaaattcctagagtgacgatgattgggtcattattttcttttttattttattttattttattttatttatttttttatttttttgagatggagtcttctctgtctcccaggctagagtgcagtggcgcaatctcggctcactacaacctccgcctcccgggttcaagcaattatcctgcctcagcctcctgagtagctgagactacaggcatgtgccaccatgccaggctaattttttgtatttttagtagagacagggtttcaccatgttagtgaggatggtctgaatctcctgaccttgtgatctgcccacctctgcctcccaaagtgctgggattacaggcgtgagctactgtgcccagcctgggtcattactttcattcaacaaagcatttctccccgcagtccatgcgcaccctgcccacagctctttctcattttcagcatctctcttccctttctagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacggtaggcagcacgggtggggacccatcactgaccgtttctggtcgttcatggacagtgctatgggtgagcctgtgtacttccactcatgggtatcatgtgcccattcacaaacagttgatattcacacacacatagccccttgatctgtatcttcccacttgtgctaggtatgtagtacccagacctctgtctcagcttgaagaaagagcatgccaagaagttgtttggagtggtgggggattgcagccatttcccccttttaccaagggcagccaccacttggctcaaggcagccagatctgctggtgcctcaagagaggccagaaccagtcttctgtaaaatatcctgggttttttttttttttttttgagacagagtcttgctctgttgcccagtctggggttcagtggtgtgatctctgctcgctgcaacctccacctcccaggttcaagcaattattgtgcctcagccgcccaagtagctgggattacaggcatgcaccactacacccagctaatttttttttttttttttttgagatggagtctcgctctgtcgcccagactggagtacagtggtgtgatctcagctcactgcagtctccgcctcccaggttcaagctattctcctgcctcagcctcccaagtagctaggactagaggcaactgccgccacgcctggcaaattttttgtatttttagtagagatgggatttcaccatattggccaggcttgtctcaaactcccgaccttgtgatctgcccactttggcctcccaaaatgctgggattacagacgtgagccgccgcgcccggccaaatttttttttttttttttgagacagagtctcgctctgttgcccaggctggagtgtagtggcgcaatctccactcaatgcaaccttcacctcccgggttcaagcaattctctggcctcagcctcccgagtagctgggattacaggtgtgtaccaccctgcctggctaattttttttttattttttattttttttatttttagtagagacggggtttcaccatgttgcacaggctggtctcgaactcctgagctcaggcaatccacccacctcagactcccaaagtgctaggattacaggcgtgagccaccacgcccagcccattcagctacttttttgtatttttagtagagatggggtttcaccatgttggccaggctggtctcgaactcctaacctcaggtgatcgcctgcatccccctcccaaagtgctgggattacaggttttagccaccttgcccagccaaatatcctgattttaaaactctgcattcaaacagcagcccggggccatagacatcctctggcccagaggcacagattgctaccatgatgggttccttgcgataagttttaaatttgtttttcaataaatgacacctgcatgtggctcagaattcaaaaattacagaaaggtatatcgcaaaaacctaccttgtcaaccagttttgcacacatattttaggttcttcagatgacaatgcaaacatgagctgggtgtggtttcacacacctgtcattcaagctgcctgaaaggctgagtcaggagggtcacttgggcccaggaagtcgaggttgcagtgagctatgatcacatctgtgaatagctactgcacttcacctgggtaacatagcaagaccctctatcttaaaaaaaatgtgtaagcaaaaaacatgtaagcaattgtgattgtatctatgtatatgttgtgtatgtgtttatcactccttttccttaaattgttagcataacataaaaatcacttatgctttttttgagatggagtttcactcttattgcccaggctggagtgcaatggtgcaatcttggcttaccgcaacctccacctcccgggttcaagtgattctcctgcctcagccccctgagtagctgggattacaggcatgcgccacctcacccggctaattttgtatttttagtagagacggggtttgtccgtgttggtcaggctggtctcgaactcccgacctcaggtgatcgcctgccttggcctcccaaagtgctggcattacaggtgtgagccactgcgttggcctatgctttttttttttttttgtatgcctctcagaatgtttctttattatatatttatttttttttttttttgagacagggtttaacactgttggccaagctggagtacagtggtgagatcttggctcacttcttctcctgggctcaggcgatcctcccgccttagtctcctgagtagttaggacaacagatgcacaccatcatgccaggctaattttttatatttttggtagaggtagggtttcgccatcttgcccaggctggtttcgaactcctgagctcaagtgatctacccatcatggcctcccaaagtgctgggatgacaggcatgagtcaccgcgcctggcctcatccatttgtcttttgtttttgtttttttgagacagtcttgctctgtcgcccaggctggagtgcagtggtatgatctcagctcactgcaacctccaccttctgggttcaagtgtttctcatgcctcagcctccagagtagctgggagtacaagtgtgtgctaccacgcccagctaatttttgtatacttagtacagatggggttttgccatgttggctaggctggtctagaactcctggcctcaagtgatccacccacctcggcctcccaaagtgctgggattgcagatgtgagccaccgcacccagcctcatctgtttgtctgtaatggttctttggtattggctgaatggatgggctgaaatttattcagtcatttaggtctattccagtctgaactgtcctgatttagaactgtgccattgaaatggagtaggtagaaggtatctgtaggatgggatcctagaaggggagttactggatcaaaggtgtggttcaggcagagtgtcaggcgacatcctcaagtctgagccccgcgcaggaactttggtagtcagctgggtggctgcgggcctgtttgtgcctcccctctcctggctctgaatgcctttccttctggtttccctcccagtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggtaaccctgagcctagggcagtcccctcttccaggtgcctctgagcatgggatgtgcccagcatccttggttccaagtcactggcgttctctttaatccatggccgctgtaggaaaaggcctcctggaacatggcacttcctccgagaaccagcagtgctggtgggcatcccctgggaagtcactgtgtggcagttggacggtcctccttggacatggcagtgcccatgttgccagagtgggaagctagcctagggctgaaggaagggcccagcgctccatcgcccagatgcgatcttaggtcccatctagctgttactctgctccctgagacatggtcccctcttagtcagaacgggaacttcagtcctaacccagatagctgatgtgaggactgttgaacttttgggttgtttctgatctttgcatggtgagatcgtctatttcccttcgagttgacacccctgggcccctctagtcagatccttctactgaaccctcactgcagaatgtgagcaggaaggggccccagggagggcacagctgtggcccccttgatgcccaaattggcacccaccagagatcttcactctggcttccatctgtccccagtgtctcatgcacatgccacacatataacacacacggttagcacagagccaggccctcagcccccgtgggagcagttgatctgcagaggtgagactttgctagaaagacatccttgactctggaatgacttgtggagaggtggaattggatgggatggtttccagagtggaattttagccattcaggcaagaggtagtcctggaaacagtcgtgtcaaactcaaatgttcccttgggactttgccggcacttggaaagtccagcatcaaaatctggcccaggaatcatgtttacgtgaggtttcccaaagcctgcagcagcagaggttgtccttaataacacaaatgacaataacggccagcatttgttgagtatttgccgtgtgccaggctcacccttatgaccaccctgtgagatcagggctgtgaccatcttcattcgacatgtcggaaactggggtccaggcctgtgacgttctggctttcccaggtgatgtgacctggaagtttcagggccaactggaccccaggtggcttgcagctgccagctgatgctctttcctggtggcagcctctgacctctgacctctgggctctttcaggcctacggaccatcggtgtcatcaccaagcttgacctgatggacgagggcaccgacgccagggacgtcttggagaacaagttgctcccgttgagaagaggtgtggctttgggggtgctggggaagcaggaggatgggtggggtccttatcattactgaaaccccagcacctgttccctgcctgcctggaagtcattgcttctccatttcaccgtaactccttctttcttttccctttgagctatgtatctttttcttctgatttgtatgcattcgtttttcaagtgcacaattaacacctgctggtttctgaaacattagaaaacaagtgtatagaaagaggaaactaaactcacccgcagccacacttcccccagacagccactggtgaatctgcagctcccagctccccagggtttataactttaattaatttttttattactttctattatgagccttcccttcccttttccttttcctttttgttttttgagacggagtttttgctcttgtcacccaagctatagtacagtggcacaatctcagctcactgcaacctccgcctcccaggttcaactgattctcctgccccagcttcctgagtagctgggattacaagtgggcaccaccacgcccagctagtttttgtatttttactagagacggggtttcactgtgttggccaagctggtctcaaactcctgacttcaggtgatccacttgccttggcctcccaaagtgctgggattacagccatgagccaccgcacccggcctattatgagcattttcaaacattcccaaaagtgtggaaaaaagttcaaagaatcctcgtggatggcttccccagcttcggtggttattattattattttcttcctggaatattttattttttcattttatttatttatttatttatttatttatttatttatgagacggagtctctgttgcccaggctggagtgcaatggtgcagtctgggctcactgcaacctccacctcccaggttcatgccattctcctgcctcagcctcccgagtagctgggattacaggtgccagccaccacgcgtggctaatttttgtatttttaattgagacagggtttcaccatgttggccaggctggtctcgaactgctgacctcgtgatccacccgcctcggcctcccaaagtgctgggattacaggtgtgagccaccgcacccggccatcttcctggaagattttaacacaaatcctaggcactggctgggcgaggtggctcacgcctgtaatctcagtgctttgggaggctgaggcaggaggatgccttgaggctgggagttcaagactagcctgggcaacatatcaagtccctgtctctactaaagattaaaaagttagctgggcatggtggcatacacctatagtcccacctacttaagaggctgaggtgggaagattgcttgagcccaggagttcgaagctgcagtgagctatgatcacactactacactctagcctgcacaacagagcaagatcttgcctctaaaaaaaaaaaaattctataaatcctaggcattgtagcattttacacataaatacccacatttcttttcaaatacttccccttgccatcccatttgtttttttctataccattcatttgtggaagaaaccagaccacatcccacatttgggatttggccaattattgttctctgttagctggtaattagatcaggttcaggttcaagttcaggtacagatcttctgataggagtaacctaagtattttttattttattttaaaaatattttaaatattttgggtcgggcatggtgactcacacctgtaatcccagcactttgggaggccaaggcaggcggatcacaaggtcaggagatcaagaccatccttgctaacacagtgaaatgttgtctgtactaaaaatacaaaaaattagccaggcgtggtggcacacacttgtagtcccagctactcgggaggctgaggcaggagaatcgcttgaacccaggaggtggaggttgcagcgagctgagatggcgccacttcactccagcctgggccacagagcaagggtctgtctcaaaaaaaaaaaaaaagaaaaatttttcaagcattttattttatcggagcagcagttttaggttcatagccaaactgagagggagatacagagatttcctatcagccctatagcccacacatctgtaacctctcccactttcaacgtgcccagcagagcggtgcatttgctagaactgatgagcctgcgttgacccattgtcaccaccccaccccacatccatggttgacatcagggttcactcttgctgttataagtttttttctttctttctttctttctttctttctttttttttttttttttttttttttgacgatgtcttattctgtcacctaggctggagtgcactgggacaatcatagctcactgtagccttaaactcccaggctcaagtgatcctccgagctcagcctcccaagtatttgggattacaggcatgtgcgattgctcctggctaggttttattttgttttgttttatttttttcagacagagtttcattcttgttgcccaggctggagtgcaggggcacaatctcagctgactgcaacctctgcctcctgagtagctgggattacaggcactcgccaccacacacagctgatttttgtgtttttagtagagatggggtttcaccatgttggctaggctggtcttgaactcctgacctcatgtgatccacccgcctcagcctcccaaaatgctgggattaaaggcatgagccaccgtgcccagccttcttttgtgtttttttaaagccattcctcccctctggcatctactctaagctgcgggcacctcctgcctttcccttcatgcttagccgcagtcatttagagcatttcttttactcctgggttttccacctcgatgtctgagatagatgtggggaaaagttcagaccttggttgccagcatcccccagcactgctgagatattgagtggtgaggcgaccccggatcccaggggaatgctgtcagggctaaattcaaaaccctgtttagctgtgaagatccggggctgagaagcaaatctgtggctggctgaggtttggggaggatttgctggtgctagagaggaaagcagaccctacccaaccccacgccctactacagccaccccgacccggctgcccttggacactgttaggcctccatcttggatcctaagggcctttggggtctgtgggcactagccaggctgaggatttggtgatatgggcctcttccccttcctcctgactcactgatgtccacagctgcccttctctgccttccttcctgtttctaagaacgaaggcgcttccactctcagctcacttgtaggcctgctcccgttttgtgacctcaggcttcagaagccctcccactggaccctttttcctggcgtactaatgactcacaactcctcctcctttacgggaacccaggctaggcgtggtggctcatgcctataaccccaggattttggaaagcacagttgggaggatggcttgaggcccagagtttgagaccagcctgagcaacacagcaagaccccatctctctcttaaaaaattatccaggctgggcacagtggctcacgcctgtaatcccagcactttgggagaccaaggcgggtggatcaaaccccagctctactaaaaatagaattagctgggtgtgttggtgcatgcctgtaatcccagctactcgagaggctgagacatgagaatcgcttgaacccaggaggcagaggttgtagtgagctgagattgcaccactgtactccagcctgggtgacagagtgagactctgtctttaaaaaaaaaaaaaaaaaaaaaaatccgtgtgtgatggtgcacgtgcctgtactcccagctactcaggaggctgagtccggaggatggcttgagcccaggagttcaaagctgtagtaagctatgattgtgccactgcaatgcagaatgggcagcagagcgagactccatctcttaattaagtaaatcaagccaaatccaagccagatgctttttactggcccctgctgtttccttctttgtgctgtcacacaggtgatggtgactctggcttcacagggatctaggttcagatcttgggtctcctactgtgacctcaccttggcatgtcttcgtttccctcctccctcttggatccaagagagatctggcgaggatgaagagcagtcacatcccacaagaccctacaggatagatgaccggcacctctcccttgcttctcaagagaaacatgcacaaccccactacaaagaaaagggagcacaggccaggcactgtggctcacgcctgtaattccagcactttgggaggccatggcgggcagatcatgaggtcaggagttcgagaccagcatggccaacatggtgaaaccccgtctctactaaaaaaacaaaaattagccaggcgtggtgacgcacgcctgtaatcccagatgctcaggaggtggaggttgcagtgagctgaggttgcaccactgcacttcagcctgggcagcaagagtgaaactctgtctcaaaacaaaaaaccccacaaaacaaaaacctagccaggagtgcaatggtaggcattccacttggattctttgcaacagtgtgtattgaattatccagcttttctcccccatatactgaagcgttaactttcagttctacctccttctcggtgtagttttggactttcttttcagttccattgatctctctggacatgaataccctgatgtacccaactgtttaaaatatactcgtttgatagtggattttagctcttccctattgctcttgtttttaagatgttatttcttttttttcttgtgagacaaggcctcgctctgttgcccgggctggagtgcagtggggtgattacagcttgctgcaacctcgaactcccaggctcaggtgatcctcccatctcagcctcccaggtagctgggactatacacgtgtgctaccacgcctcgctaatttttgtatatttttgtagagatggggttttgccatgttacccaggctggtctggaactcttgggctcaagcgttccacccgcctcggcctcccaaagtgttggaattacaggcgtgagccaccgcacctggccttgagattttttttctttttctttttctttttctctttctttttattcagagtcttgatctgtcgcccaggctgaagtgtagttgcatgatcttggctcactgcaacctccgcctgccgggttcaagcggttctcctgcctcagcctcccgagtacctgggactatagtcacgcgccaccatgcacggctaattttttgtatttttagtagaggcggggtttcaccatgctggccagggtggcctcgagctccttaccttgtgatctacccacctcagcctcccaaagtgatgggattacaggcgtgagccaccgctcccggccgagatttttttctcacctatctttgaatctcagcttgtagatttcatctgccccaaagcttttttctgtccctgcgcacacaggctggatgtgagctctccttcctccaaatacttaatgttgctcttcgcagctgccatgtgcattcgcaccctctgtgttgtttctgagtaacatgttatgacagctgtgagtgcctcgtgggacaggatccatctctatacttgaatcttgcccatccccgtgccaggtccacttggctcacctagctttgcccctgacctgactgcctctccccacaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcaggtactgcaagggtttgcacgtagtgtgcagtggcataggctgtgcactgcacaacagctgcaatcctcactggcacttgtttcaggctagagcagcacttgttttagcaaaatgggttcagtccacatttagcctaggagtttgagaccagtctgggcaacatatggagaccccatctctaggaaaaatagaaaaaattagctaagcatggtggcacatgcctgtagtcccaggtactcaggaggctgaggcaggaggatcacttgagcctggaaaatcaaggcttcagtgagccatgttcatgccactgcactccagcctgggcaatagagtgagaccctgtttcaaaaacttaaataactaaataaaagaaatgtacttgattcagggtctggtgaagagcagatgttcagtgacttggtgctgctactattacaaccatcactgttattattaccaaaattttaattatcattgtaattattcagtcatttacccagaagactgtatgcattgcctggggttggtgacagggggttaataactcttttttatttattattattattattattattattattattttttatttttggagacacagtctcactctgtcacctaggctagagtgcagtggcatgatcttggctcactgcaacctccacgtcccaggttcgagtgattctcctgcctcagcttcctgagtagctgggattacaggcgtgtgccaccacacctggctaatttttgtatttttagtagagatggagtttcaccatgttggccaggctggtctcaaattctgagctcgagtgatccgcctgtgtcagcctcctgaagtgctgagattacaagcatgagccaccatgcctggcctatcgttctcttcttgtaagtaattgattcacatggtgcataaacagaaatggtattaaaagctatacagtgggccagtgtgtggtagcaggggcaagacgctcctcctcgctgttttctagcaccttccagggtggcagcagggcctcagcagcactccagcagtcatcttttcatgcacatatcagggggacacagtgtccacacgagagtaggttcctgtccttgtagaaggcataattctaatgggggagactgacacccaacaaaccgccagataaatgcacgatcaagaatccagtaggggcgcgggggccgggaaaagagccacccagagaaggcagctcaggagagcaaagagggaagtcagtgtctagagggaggggccctccaggagaggaagctggggtgcttacaaacgggagtagggagaggaagggaagtaaaactccgcagctggctggggcctcctgagagccagcagtgaaaagtccagctggcctccagggagcctggagggggctcagcctccttccacgtggggtgcttcccagagcagcagcgccccttcctctccatttgctcatgacttaagtgccctagtatcctgtcacagaccaagggaaggccagcgtagctccctgcctttctaggcagcccacatagacgggggtcgatggccagggctgcagggcagggacccttggtcacggaggtctttgggttaccccacttgctccatgccatagatgtgaggttccttcatgcctcttttctagctcgccagacactttgtatttattttttatttttttgatgattttttttttttttttttttttgagacagagcctcactctgttgcccgggctggagtgcagtggcatgatctcagctcactccagcctccacctcccaggttcaagtgattctcatgcctcagcctcccaagtagctgggattacaggcgtgcgccaccacactcaactaacttttgtatttttagcagagacagggtttcaccatgttggccaggcttgtctcctaatctcaggtgatctgcccgccttagcctcccaaagtgctgggattacaggcgtgagccactgtacccatcccggccttcccctcaaccccagatggagtctcgctctgttgcccaggctggagtacagtggcacaatctcggctcactgtaagctccgtctcccgggttcacaccattctcctgcctcagcctcccgagtagctgggactataggcacccatcaccacacccggctaattttttttttttttttgtatttttagtagagacggggtttcaccgtgttagctgggatggtcttgatctcttgacctcatgatctgcctgccttggcctcccaaagtgctggaattacagtgtgagccactgcccccggcccatgcccagcctttttgatttttcagacaaggtcttactctgttgtccagaatggattgcagtgacacaaacacggctcattgcatcctcagcctcctgtactcaagcgatccttttgccttagcctcctgagtagctgggactacaggtgtgtgctgccacacctagctaatttttaaaactttttttatcttttgtagagagaaggtctcaccatattgcctgggctggtctcaaacgcctatcctctagtgatctgtctcaacctccccaagtgctaggattacaggcgtgagccactgcacccagctttctctgttgtaggacagatggccaaactctgctttacactttgcaagtataggctgattttatggctttgtttttctttttctttttttttgagacagagtcttgctctgtcacccaggctggagtgccattgtgtgatctcggcccactgcaacctccacctcccgagttctttctcagcctcccaagtagctgagactacaggcacccaccaccacaccgagataatttttgtattttttggtagaaacagggtttcattgtgttggccaggctggtctcgatctcttgatcttaagtgatccttctgcctcagtctcccaaagtgctgggattgcaggtgtgtaccaccatgcctggcccacatttgtctattttgaatcttccttgcttttctctgtagatgcagatgcagccggggagctcatcttgagtgcattctccaccttttcaggggcgatctttccatcttagtttgtagggcctgtccccatgtgtgttcattggcccccgtttccgtggtctggatggactgtccttgcaagctgttgcttgtcctccaaggcgtggataggcccagtgcctgatgtcggccccgtgggctgtttgtagcctcttacactcatgggcagctccgtgccgtctccgttcccagacatgagtgtgtctgtggcttgatttatctgttgctgtctctcaaggctgtgtggtgtggtggccgcatagtggcaccctggtgttggcccttggttggggggagtgtgtctgccactccctggtatcctgcccatgccaccctttctgatctctgacctctctcctgcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagtatgtaccccggcacccaccaccaccaccaccctggcccctgccttccatcagccacagggccccctaggctgggcaccactcatcactcgtccactcattgattcagcagacacttgctgcaagccttctgcgtgccaggctccatcctaagcatggcattcgccccagtggaggggacaggtgtccgtccctgcccctggagtgctcagaatggggggaagtgggacgaatgggacaaaaaacaagaaagaaaatgtatagtgtgttaaatgtcaaaatatgaaagtggtgctagtgtgggagttgtcgggaacagcctcctttagaaggtgagcattggccggccaggagcggtggttcacgtctgtaatcccagcactttgggaggccaaggtgggtggatcacctgaggtcgggagttcgagaccagcctgatcaacatggtgaaaccccgtctctactgaaattgcaaaattaggctgggcatggtggctcacacctgtaatccccgtacttttgggaggccgaggcgagcggatcatgtcaggagatcgagaccatcctggctaacgtggtgaaaccccatcactaccaaaaaaaaaatacaaaaaactagccaggcgtggtggtgggcgcctgtggtcccagctacttgggaggctgaggcaggagaatggcgtgaacccaggaggtggagctttcagtgagtcgagattgcgcaacttcactccagcctgggcatcagagtgagactctgtttaaaaaaaagaaaaaaggccaggcacggtggctcacgcctgtaatcctagcactttgggaggctgaggtgggtggatcaccaggtcaggagattgagaccacggtgaaaccctgtctctactcaacgtacaaaaaaattagccgggcgcggtggtgggcacctgtagtcccagctacacaggaggctgaggcaggagaatgacatgaacccaggaggcggagcttgcagtgagctgagatcacgccactgcactccagcctgggtgatcgagcaagactgtctcaaaaaaaaaaaaaaaaaaattgcaaaattatccaggcatggtggcacatgcctgtaatcccagctacttgggagactgaggcaagagaattgcttgaacccaggaggttgaggttgcagtgagccgagatcgtgccattgcactccagcctgggtgatagggcaagactccgtctccaaaaaaaaaagatgagtgttggccaggggtggtggcttacgcctgtaatcccaacattttgggaggccgaggcgggaggatcacttgaggtccggagttcaagaccagcctggccaacatggtgaaacccctgtctctactgaaaatacaaaaattagccaggtgtggtggcaggcgcctgtaatcccagctactcgggagactgaggcaagagaatcgcttgaagccaagaggcagaggttgcagtgagctgagaacgtgtcactgcatatcagcctgggcaacagagtaagactccgtctcaaaaaaaaaaaaaaaaaaagaagttgagtgtcaggcgaagacctgaagcaggtgagggcagggcaggagccgtgtgggattaagcccggccagtgcaaaggccctggggcaggactgggccgggcatgtcagaggaagaccctgtggctggatggagtgagtgaggggagtgggaggaggtgatagagcaggttgtgcagggccttgtggggcctcagggaggacattggcttttgctgtgagtgaggtgggagccatggacagttctgagcgcaggagagtcaggactgactcaggtgctcacaggctccctagccgtggtgggagaagagacatgggagagcgggtgggagccagaccttggctaggttaggtccctctccagcttggcctcttaagatccaccccatgacttggttggtgcagctgcttagctgtgagattgggaagcaggtgtgcccccacaatcccaaattctcactcggggactcttctgcctctgaccttttggcttttggcctgtaagggaccttgaggcactggaacagctggaccagagcaggtgacagggacacctgggtagctcatactgcagacagtgccatgcatgaggcacttcccacagggacaccaggaggacaccgcctcctctggccatcacagccctggcatccccccaccccctctgccaggcagtagtgcatggtcgtgggctaaggggccagagtgcttttatgctcagacagccttgactacgttacaaaacactttctacagagcagatagtggccctttgcaggcttcaggaggaaattcatagccggggatggtggtgcacccctgtaattctagctacttgggaggctgaggcaggagaatcgcttgaacccaggaggtggatgttgcagtgagccaagattgtgccactgcactccagcctgggtgacagagcaagactctgtctcaaacaaacaaagaaacaaacaaacaaacaaacaaaacacaagattcagcctactagactgaaggaagtgttgttgtggaggattcagcctaagggtggacctgggcctgctgggtgaccacaggcaggtgattggacctctctgagcctcattttctgcacctctaaagtgagggtcatagcagctgtcatctcacatggccatggggacaaactggcagattacaaggtgcctgtaatcccagcacatggggatgccaagtcaggaggattgcttaaagccaggagtttgagaccagcgtgagcaacaaagtgggatcctgtctctgaaattaagaaaaaaaaaaaaaattaggctggggacgatggttcacgcctgtattcccagcactttgagaggcttcagtggatggatcacttgaggtcaggagttcaagaccaccttcaccaacatggtgaaaccctgtctctatgaaaaaatacaaaaattagccaggtgtggtggtgggcacctgtagtcccagctacttggaaggctaaagcaggacaatcacttgaacctgggagtcagaggttgcagtgagccaggatcacaccactgcactccagcctgggcagacagagcgagactgtatctcaaaaataaataagtaaataaataaataaataaatttaaatactacttgttaagcctatggcaggactgggccaggggatgcccatcacaaacagtccctgtcccccggggcttagcacgttacgtcatttgtaaccagttgccttgcagggccctccctgcccaggcactctcaccatggagaagcgccactgttatctgtgtctcctgtcaagagctgggccttcttgctttagcattttatctgagggtccaaggtcctcatgcagacatgggcggtctttctcggttcacgccttacaagagaacgggaattacggtaatagacttcccccagcctgaattctgcacttggcttttctcttcttgttaaagcaaagcctggagccttctgtctccgcctggtgcagcccacagactgttcatgtatcccagtgcccatggggacacccagggtttttttgtttgtttgtttgtttgtttttggccttaaccgatgcttgtaagttcatctgtgactgtacaggcaaggattcctgcagggcaaagaccccagcagagggatcttgggttaaggaacatacgtgtttaaaattgatttttaatttttcattttattttatttatgtatttggtggttttttttgtttttgttttgagatagagtctcgctctgtcacccaggctgaagcgcagtggcatgatctcagctcactgcaacctcccaggttcaagcgattctcctgtctcagcctcctgagtagctgagattacaggcatgcgccaccacacccagcaaatttttgtatttttagtaaagacaggggtttcaccatgttggccaggctggtgtcgaactcctgaccttaggtgatctgcccacctcggcctcccaaagtgctgggattacaggcatgagccaccatgcccggacctcatgtatttgttttttaaacggggtctcgccttgttgcccaggctagagtgcagtggtgcaatcccggctcaccgcagcctcaccacttgggctcaggtgatcctcccaccacagcctcccgagtagctgggaataatacaggtatgcgccaccatgcctagctaatttttgtatttttgtagagacaaggtctcactatgttacctaggctgatcttaaactcctgacctcaagcaaaccgcctgcctgaactttccaactatgagatcgcagacgtgaaccaccacgcctggccttgtttttttaatttttatttattttattttattcttttgagacaaggtctcttgttctgttgcccaggctggagtgcactggtgcaatcacggctcactgaagcctggacctcctgggctcaagcaattcttctgcctcagccacctgagtagcctgatcctcaggcgtgcaccacagcacctggctaatttttaaagtatttctagagactggatctcactatgttgcccaggctgtctcaaactccttagctcaagcgatcctcctacctcagcttcccgaagtgatgggattacaggagtgcaccaccatgcccagcccaactccccctttttataaggacaccagttatattggctatgagcacaccctgtgatattctcttgactgattacatctgcagtgaccctgtttccaaataagagtacattccgaggtacaggggggcaggattcaacccgaattccgcgggacaccgaccagccggtcacaattgtccagaatgctctgattgtgcagcgtgggttgggcctgtaaatcacctccagggcccccaggaggctggtgcccaggtgtgctttgtcccctgtggctgagagcaggtccccagagtctccatccttgcctaaccctccccctccccccgtcgcccagtctgttgtctgtcattagtttagtgctatgcctttgctgaccttggtcctggtttggtccacaattcaaattctccattccaggctgggtgcagtggctcatgcctgtaatcccagcactttgggaggccaaggcgggcggatcacttgaggtcaggagattgagagaccagcctggccaacatgccgaaaccccatttctcctaaaagcacaaaaattagctgggcatggtggcgggcacctgtattcccagctactggagaggctgaggcaggagaatcacttgaacccggcaggcggaggttgcagtaagctgagattgtcccattgcgctccagcttgggcgacagagtgagactccagctcaaaaaacaaaaaacaaaaaaaacaaattccccattccaggtgaagcattaacctaggcctttgtgtgtctcctggaaggaaattaaatgtgcacaccctttacttcatgtgaggaaagagattttggggatctgggcagcttgtgcttgcctctcccagttggggtatgaaggagacccccctttctttggcagcccagccttggtggccctgacagtggtcaccatttgagcagttcccctttaggagcaagtccccaggtacttcagtagatcatgatttttgggagggaaactgatgaagggagacagcccagtaccctaaggagagcaattaggaatgcttaggaaaactaaaacgtgaacaagatcatcctacttttttactattcacgatgccaataggcaatgctgagagactctttttaagggccaggcccgttctaaggggcgacacatgttattaccactttttgtccattagatgagcaattgtttaccaacaaaaattttctttcttttttttcttctttttttgagacagggtcttactctgtctcgcccaggctggagtgcagtggtgcgatctcggctcactgcagcctccgccacccagattcaagcggttctcctgcctcagcctcccgattaactgggactagaaacgtgcaccaccacacccagctcgtttttgtatttttagtagagacggggtttcgccatgttgtccaggctaatctcaaactcctgggctcaggtgatctgcctacctcagcctcccaaagtgctgggattataggtgtgagccaccgtgtccagtatatatatatattttttaataaaatgtggtctcactgtgttgcccagggtggtctcgaactcccagactaaagccatcctctcacctcagcatcctaaagtgctaatattgcaggcatgagccaccgcacccggccaataaaacattttaacttgtgtgaaaccaggtgtctttgcagaattaccattagtggcagcattttttctttttttgtgggcacacaaaataacagtgcattttaggatcagtgacttcttggaggtaatgagatctaaaaacatcttcagtctccacgaaggaggtagatgttgttaccctcaacccattttgtagatgaggaatcggaggctcagaggggcaaagtcctgtccaaggcctcacatcccatcgatgggtcaggaccaaccccagcaggctgggaggtggcgggaacctatggaagccacctgaattgtggggaagtggctacctttccttcccagcatcctgtaaatcaagttgagcttcagggcagaggtgctgagctttgacccctgaacttcactcctgtcttctgcaaagtgggaggaataagtgggccttctcagatcgaatgggtgaataatcggaacaggcttagcttgagcctgactcgtagccagcatttgccattgggagctcttgaatttggtttatttgtcttaatatagacagaagacattttgctgctgaaaaatggtaaaagaacagtaaaccctggcttgacttggaacatcattccagagtagtgtggaaacctccgttttgatgcttgctttttccttttcctcataggatggtccagcagtttggggtggattttgagaagaggatcgagggctcaggagatcaggtggacactctggagctctccgggggcgcccgaatcaatcgcatcttccacgagcggttcccatttgagctggtgaaggtagtgccccccggggctgggccctcccgtctctggtcaggcaccctcctgctggcctcaagccaggcctcctcccaggcaataaggtctcaagctcctacctctaggcctgaacttgtggtgggcagggtgtggcctggatgaggtgtccccatgggcttccttttctgacactcagctttgaggttttgggcagaacaatatgaaaacccctgtgtttttcctctgacaaaagccaatatacattctttgcaaaatacatagaaaatacagataaatttacatgagaagatgtccctagcatgtcattgaagaaggaaaaaataggcattggagccagcatgtgcaacatagcactgagctgatatatacaacatccttatgtatgaaactgaacatggatgtctgtctacaagtgtttctttgtatttgcaaggatgtttgcaaaaatgtcagccctgggtgctaggatttgggacttctttttccgtgtgtgtgtgtgtgtgtgtgtgtgtgtgtgtgtgatttgcttgaagttttatactgtttacaatgagcacatagcattttttattaaaaaaacaaacagttttttaaaatcagaggagcaagaccaaatgcagtggctcacgcctataatccgtgggaggccaagggggcctgatcacttgagcccaggagttcaagaccagcctgggcaacatggtgaaaccccatctctactaaaaatacaaaaattatccaggtgtggtggcatgtgcctgtagtcctagctacttgggaagctgaggtaggagaatcacttgagcccaggaggcagaggatgcagcaatgagccaagatggcaccaccgcactccagcctcagtgacagagccagaccctatctcaaaaaaaaacaaaaaaaacaaaaagaaagaaaaaagaaaaagctgggtgtggtggtgcatactgatagtctgaaaaatctaagtttacatgaatttatattcccaccaatatgatgagagagttggtgtcatgtcatgctttctgaaactgggttttaattaattaatttgtttgtttatttttattttttttgagacagggtcttgctctttcacccaggctggagtgcagtggtgcaatcacagctcactgcagcttcgaccttcctgggctcggatgatcctcccacctcagcctcccgagtagctgggactataggcgtgcaccagcccacctggccaatttttgtatttttagtagagatggggtctcactatgttgcccaggctggtctcaaactcctgggctcaagccatctgcctgccttggcctcccaaagtgctgagattacaggtgtgagccactgtatctggccagttttcaattttttaaataaaattttgacgagttaaatattctgccttgtgaatatagccacacgtgggagagaacgttccccagatgcacgcctgccacgggggcgccccgggtgcctccatgcatgtgcttggtttgtctcttctcagatggagtttgacgagaaggacttacgacgggagatcagctatgccattaagaacatccatggagtcaggcaagttccacgaggagagtcaccactgttccttcctctccgtggtgcgaccccccagctaattgggtcacccacacctctgagtccctaatcgttaggccttaagagggctcttggatggttttctgtagctgcgagcccctccctgagggtctccaagggcacatgagggtggatgtgtcttagtcctgcgtccattgcaggcttcagggctgtctgcagctcctgatcaaatagggcttagttcctgcccagtcggttggtgtgaacctcatgctaaactaagaatgctcactgcagatttgcctggggaggggcggggcggcactgaatcagggttttgggaagccagcatgagtccccatcatggcttcctcgtgagcctcttgggtcccctccttattctaacaaaggtagttgctccaggtgtctgcccttccatcgccgtggggtcctcgggtcaccctgagggtttccgggcagtggactcaggcatccgaccccacacatgacacaaccttcattccttgttggggacccggccagggccaatgaaattgctgaccatgctttgtttctctctgacttatctcccctgcccccgggtctggacggtttcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaaggtattgctccctcggcagggtgactcctgaccttgtggaaacgggggtacgggggtttggtatcaggctcccagcgcctcattggcccccactggtgccttttctccccatatcgctttgtgtccgtgaacttggcctctccccagaggctggggcaggagcatgtaggcctgggcccaggcacacaggggagtgccaggcctcctggactggccagacagatgcacagttgtccctgggaccctgataccaagcctagcatgtgtctgatgaaattggggtttcactgggctgttgctttgctgcctcctgggaagcagagagggaccccccgcgtcaactgctggaggctgagctccttgaagctccctggctgtcaccccttcttgaccaatgcccggcattctcagacttccctggagccaccgacttctctgtccctcagctccgggaatggcctgaatgccagcgacatcatgagagccagctggggtcctaagtgcccctgcccaccccctgcaccccacgctgtcccccaggggcagcccatttttggatccacttagtcacagtgcctctatgcgctctcgacgagccactgcctccactcagcaggacgcgccgggctcccccaacccgcgccaacgccgcgggcctggttcccagggcagcacgctttggccaagcagctgaaatgcctcccagtgggcagtctgtgcttgcgcgaccacagtgtccccagcgctccgggttgccagggaatttctgcttgagcccctctgttcttagtctggaaaagcccacatttgctgcttaagcttcttcgattagaaaagggagggggaaaacagtccaaacaggttggaaaacgctcgtcctagagccaggtgtcatggacatgaatgttagaggactccgcacaccttggctgtctgtctgtgcaatgacaaccccccgtggcccttctgtaactacaccccagaccgagcccacacccccaaaccccagacctctttgatccgaagcagcttccggggcaaatgcgggcgcaggctcccccatgcatggactaatcagatgactctcgtttcttctcttctctctgtctcctgtcctgcgtgtgtggcctgcactgtccctgggtgtctttctgcctcatcctgccctccgcatgacccaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaaggtaacaggttttgttctcatctccgcatttgtccccgtcctccccctccatgtgttagtctcaacccgagcatctggaaaattcagcctcggcaggaacccccttccgcctaccagttgtcacttagagatgtcgccaccttgcattggcagatggaatggggggagtggcatcacacgtgggttgtggctgcccgtgggggcggtcagcctttgttgttgccaaacgcattgcatttactaagcagtgccctttcctggaacccctagagaaaggggtttcccagccagcaccaaaacagcaaaacacaggaaacacatcatctgtatagccctgcatgttctcacagtctaggccacctgagagtaaccattccattttccccgactcgtggacttgacccacactgcagaagatgggactcccctgtgcatgaggtctggttaagttggtgctgcagatgaagcctggggaggtgggggcatttggcgagtgtgtgccacagatacagtgatcaggagtggttctctgcaaggagttcctatcgaggctgatggcccagatacccgccttaccattctagaacagacgctactcactcacgctggcgaggcccttcagggttcctgctctcacccagtgctgggcaagaggggggtgccctgaagccctgcatggcaaacatgcccctgcttttctgctttcatgttgcctcctgcctcctgccccccggtcactggctggaaaagcagctctgctctcctgctgtctccggtccacggtgcccccactcttctgctcttagctcccagctggactcactgggggccaggagcaaggtgtgggctcggtgggccccctcatatctcattccccacccccctccgcattttctacctgtgtggttcatgttgcttcccgtgccacgaggaccccgccaatgcgaccactctgcttgttcccccagctcagttcctacccccggttgcgagaggagacagagcgaatcgtcaccacttacatccgggaacgggaggggagaacgaaggaccaggtactggccttttgtcttctttattgggtataatttacatgcagtaaatgtcaagtgtactgttctgtgcatgctgacagctgcatatggcaaagtaacccttacctcaatcaagatacagagcggttccgtcacctcctaaaatccctgtccctatcatgctgacagctgcatatggcaaagtaacccttacctcaatcaagatacagagcggttccgtcacctcctaaaacccctgtccctatcatgctgacagctgcatatggcaaagtaacccttacctcaatcaagatacagagcggttccgtcacctcctaaaatccctgtccctatgcccctttgtagtcaacctctcaaaaacccacaggccaggctgggtgtagtaactcacgcctgtaatcccagcacttagggaggctcaggcaggaggattgcttgagcccaggagttcgagaccaacgtgggcaacatagcaagaccttgtctctacgaaaacataaaaaaattagccaggcgtggtggcgcatgcctgtggtcccagttacttgggagggtgaggtgggaggatcccttgagcccacaagatcaaggcttcagtaagttatggtcgtgccatcgccctccagcctgggagacagagcgagaccccgtctcttaaaaaagaagcagcaaaggaaatccccaggccctggccaccaccagcccgctccctatcctacagtccttcaagtggactcccacaacgtaaggcccattgactcttgactcccttcctgccacccttcttccctccctccctcccctcggcgtctgcatttgggagccaagcgtgttgtttgttgtatctgtagtttgctgccttgattactaagcaatcttccagggaatggatggagcacagcaaggacctccacttgcctgctggagggtgtttggggtgctttttgtgttgtggttttttgtttttttttttttttttgagacagagttttgctctgtcgcccaggctggggtgcagtggcacgatcttgactcactgccacctccacttcccaggttcaagtgattctcatgcctcagcctccgaagtagccaggactacaggcacatgccactttacccacctaatttttgtatttttagtagagagagattttcactatgttggccaggctggtcttgaactcctgacctcaggtgatctgcccgccttggcctcccaaagtgctgggattataggggtgagctaccacgcccagcctgctttttctttttttaacatttaacgctttcttgcaaaggcatgcaagcacacaccccaagttgctgcctacccctcagctgagactgtcacccacgaagcactgggccgtccttatactctcctgcagccgcagcctcagcctcccaagtagctgggactataggcgtgagctaccacgcctggctaatttttgtatttttagtagagatgaggtttcgccatgttggccaggctggtcttgaactccttagctcaaatgatccacccacctcagcctcccaaagtgctgggatgacaggtgtgagccactgctcccagatctgttttgagtcactttctctcagttgtcctctgtgttctttttacaactgtttgttgaaaccagagcttaattaagcccttgcttgctatgtcactttgtttaaaatggtccctctccccttgccattgatggggatgaaatgggctcatttgtcctgcagggaggcgcccagttttgatttggccaattgctccctcagggcaccagtccacctatgcctcatagctgctgtagcttggaaattgtatcaaaagtctggaagagtctgattctttttgttgttactgttggtaagaatgctgccggcccttccacagcccctggtgcccacctgccatgctgccaggccggatctgagagcgctgggttgaggagactcaggccttactaaaccagccacgctcgctcccacagatggagcaccctggcattttccagcaggcgacaggtccgagtgccttgccctactttattctcaggaacttggaggtgcagtgaggggaagtgactggccaagggccaggggagtccagtgacgcgcatcccagcgcctcctccccagcagcctggcctgttataaatgggaatcaagccagtgagctgcctggatccatggttcccatagaccaacttcatcctgggcaaaagacaagaaggatgagggagggagagtttcagcaagtgcagtggactcataagccctgctcctcacatgagacctttctagcttgatagcttgagcgtgtgtgtgtgtgcgcgcgtgcacgtgcacgtgtgtgttttattttagtgttcataattggacaaattagcttcgcagttttaatgcaacactttgaacacgccaggcgctaaagactttacaggctggacacggtggctcacgcctgtagtcctagcactttgggaggccaaggcaggtggattgcctgagctcaggagttcgagaccagcttgggcaacacggtgaaaacccgtctctactaaaatacaaaaaattagccaggtggtgtggcgtgcgcctgtggtctcagctactcggaagactgaggcaggagaattgcttgaacccaggaggcagaggttgcagtgagccgagattacgccattgcacgccagcctgggtaacacagtgagactctgtctcccaaaaaaaagaaaaagaaaaaaatacaaggcagtggcttgcagtggttcacacctgtaatcccagcactttgggaggccaaggtaggaggatcacttgagcctaggagttcaggaccagtctgggcaacatagtgagaccccacctctacaaaaaaagaaaaatcagccaggtgtggtggcacatgcctgcgaccccagcatcttgggacgctgaggcagggggttgcttgagcccaggagtttgaggctatgattgttctactgcactccagcctgggagacagtaagttcttttctcaaaaaaaaaaaaaaaaaaaagccaggcgcagtggctcatgcttgtaatcccagcactttgagaggccgaggcgggcggatcatgaggtcaggatttcgagaccagcctgaccaactcagtgaaaccctgtatctactaaaaatacaaaaattagctgggcgtggtggcaggcacctgtaatcccagctatttgggaggctgaggcaggagaatcgcttgaacccaggaggcagaggttgcagtgagccaagattgtcccactgcactccagcctgggcgacagagcaagactccgtctcgaagaaaaaaaaaaaaaaaacaaaaaaaacaactgcacattattaaacccttggcagttgggcctcctgtcaccccattccacagctcagtaacgtgaggcccagggtcacacggccaattagtggctcaatcaagactccagaccttggggacagcggccctgcctgtgactggcacattgggctgcgtggctgtgctctgttgtcccaggctctgttgcctatgagggtgtggggagtgcgacgccagcccctgttctcctgtctgggaagcctcctggttcccacgccttccctgctggcaaggccaggaaatgctcttgccgctgcccccccttgccaggcttggccttgtactcacagtgacccccgctctcccccagattcttctgctgatcgacattgagcagtcctacatcaacacgaaccatgaggacttcatcgggtttgccaagtaggtacttttagagactggctggtcgggcggcaccaatcctcactctcagatccaaggaggtgactgagttgggattctctgagagggcaggtgtcagacagtctctgtcgggggtcctggggtgaaggcagagccaactgagaatatctggaagctctcctgggctgatagtggtccactgtccccaaccaacacgccttctgtgaggcatccccatggttagtttagggagagggcagtgctatgttcagatctgcagggagagggggaagccagccagctgctgcaccccctctccttcaggacttctcagagcctttagcgaccagtgtgcagcttttcccagactctgccacttcatggacagcatctcatgggctcagggctccggaagctgctctttgggaaatgctgcctggggtctccctagcttcaaggcatacactgtagatttaaaccagaaccttccgtggcacccagatgagggcccacatcggggagccctgatttcagcaggatgtcgattcagtgtgcgtggtctcaggcatcacccgctgattccttcagccccttggcatgcttaggcctcactcagattgttggagaggctcacgcaggccttcctgcctgaggcaggccgggtggtgccgctggtatgccctctcgctgggccctgtgatagagcagtgggcaaacccacacccagctccccaccctcagaggaagaccacatgcagggaaccgatggggacccagggcgttaaggtgtagtgtgcttagtgctgggcggggccgtgcagggcttgtgggtgtccagagggcggccactgggccttgccttgaggggtcaggcaggcttcctaggggagggcctctagagccaaatctcaggctatggagtcaccagatacaacatttatcggtgcacctgacaaagctgattgaggatctgttccgtgctgggcaccaggtaggtgaggagaagggaggaaggaaaacgaaggaatgagggcctcatcagaacccctcctagagatgagccgaagtccctgactgggcctcccctgcctgtgggtggcagcccccggccctgtgctcccggccgccgggtgtgtgtgggctcacagcgctggtccccatctttggtttgctgctgttttcctcaccttgatgtctctgcttctcacacttcatccacagttccttctcacaatctctcctgtttttcctttgaccactctttcctctggattcctgggccttcccacttaccccagctgttactatactgagcagctggtgacctggtgggtattgcctgctgtgtgcctttgccctggtgtgtgaacggggtacgccctggctgggtggccccagccctgggtgggacatccctggggcccgctgaagagctacggggtgctctctcagagccagggccagtgctgggcctctgggccaggaccttgaccgcaccagctgtagcccctgctgtttcagagcctgcaggctggggaggtggagtccttaaacaaattgtcacaaggatgatgagagtaggaagagagggtaggggatagactatgggaaaggggagctgggaatgtggcctggagagatcttcctgaagaagtcaggtgatgccagggggacccagagaattggacccagggaaggaaggctaccagaccaggcaggtagaggtaagagagccagcggccaggccccatcgccaggagggccctgcaggtccaggggaggattttggattttcccccaagacaccaggatgcttctgattagatccaggcccaggagaggggccaccttgtgggctgctatttgagggagccctggcaaggatgggagccaggaggcccttaggaaatagcacctctggaacctcactgtcacccagccatcactgtggaggttggctcagctcagtgccacctccttcagatgctgttgatgaaaatccttcttgtgcttgaatgttctgggcttcccattgccctccaaatgtatattataaacagggcccaagcctggcgcagtggctcatgcctgtaatcccaatactttgcaggaggccaaggtgggtcgattgctggagcccaggagtttgagaccagcctgggaaacatggtgaaaccctgtctctacaaaaaatacaaaaattaactgggcatggtggtggtgcgtaatctcagctacttaggaggctgaggtgggagaatgacctgagcccaggaagtcaaggctgtgctgagccatgatcacaccagggctctccagcctgggtgacagagtgagactctgtctcaaaaataaataagtaaataaatagcccagataagaagccctataataaacttactgaatgttgggaatatcactggataaaattctgcctttgttcttagttttccagcctttcctgatctagaaacagaagcctactttctcccttatcctacagccaacttggactttaaaacaaaacccccgaggtagtcagcaaaggaaggtgaccaagctgacttgcttttccatattgttctgaaagtttcagccaaagcaataagaaaagacaagaaaatatgatggataagtaacaggagatatatgttgtttgcaagtggtgatatgattgtcagagtagaaaatatattagaaccgtaaggtggtggagtaggtgtccacatataaaatatagtgggatttgtctatgccggcatgaactagccaggaagtaggatggataaagaagaaaagagatctgggattgtggatgaataaggaaccttatagaaacacaccctgtcgaccttggatgtcctctaaatttgggtcaggagtcatgcaagatatgtgtcatttcatgaccagcagctgtcccacagtctgatgtctaagactggatggctctgtggttagagccacttacaggctggtgttgggatcaaatgatgagaagagtaggaagaagggccaggtgcagtggctcatgcctgtaatgccagcactttgggaggtggagccaggcagatcccttgagtctaggaatttaagaccagcctgggcaacacagtgaaacctcgtctctacaaaaaatcaaaaattagctgagcatggtggtatgcacctgtggttccagctactcgggagactgaggcaggggaactacttgagcccgggagggtcaaggctgcagtgagctgtgattgcgccactgcactcatcttaggcaacaccttctcacacttccccttagaaactccgggattctagtgacatctggaagtaacctgcgctttagtaagtcggctgagatgagggcctagaagcctcaattgaaccagatacatttacttgttccgtgtgcccaggccgtttcccttgcgcagctctgtgtgtgcagggggcttctctctgcctctacctgtggctgctcacttggtccccagggagagaacggccacattcgcctcttccccttcttcccccccggcatcttgtccacgtgaaccctgtctgttctttggtttcagtgcccagcagaggagcacgcagctgaacaagaagagagccatccccaatcaggtagcacacccctctgcagtctcccgctctaccctgggggcgggaggacgctaagtgacagctaagcccccgtgatggagctcggcctgtgtaaagccccaccccacagcctcagtaccaggccatctgctctctctagaggccacttaggaattgataattctgggagatggcctgagagccaacactctggcagggcctagtgggcacattttacccacccagaaggccctatgtgccatccaaggccagggttagaacttgactcttggctgggcacagtagctcacacctgtaatcccagcattttgggaggccgaggtgggaggatcacttgaggctaagagtttgagaccagcctgggcaacatagaaagactctgtctctacaaataataatatttaaaaattacctgggagtggtgggctcatgcctatcaccccagctacttaggaggccaaggtgggagggtcacttgagcccagcagttcatgaccatccggggcaatacaatgagacctcatcttaaaaattaataataggctgggcacgatagctcacacctgtaattctagcatgttaggaggctgaggcgggcggattgcctgagctcaggagtttgagaccagcctggctaacatggcaaaaaccccatctctactaaaaatacaaaaaattaaccaggcgtggtggcacgcgcctgtaatcccagctactcaggaggctgaggcaggaggattgcttgaaccttggaggcggaggttgcagtgagccaagattgcgccaccgcactccagtgtgggtgacagggccagactctgtctccaaaaataataataataaagatataaataagaatttttcccttgagcgggggtctgtgacctctttgagctttccaacacagccccagggattgggagcccctaggtgagagccgctggaaactacattgtcactagcagctcaggggagcttgggatagttgaagccccacacctggagaagccctgagccacaaagggttgtaccttgacatcttaacccagctagaggccttgtgaaatatgaacggctgtatcaatgcctgccttcagtaccttattattattattattattttgacacagagtctcgcattgtcacctgggctgcagtgcagtggcgcaatcttggctcactgcaacctctgcctcccaggttcaagcgattctcctggttcagcctcctcagtagctgggattacaggtgctcaccacaacaccaggctaatttttttttatttttttcttgagatggagccttgctctgtgtcccagctggagtgcagtggcacgatttcagctcactgcaacctccacctcccgggttcaagcaattctctgcctcagcctcctgagtagctgggattacaggcgcccgccagcacgcccagctaatttttttgtatttttagtagagagggggtttcaccatcttggccaggctggtctcaaactcctgacctggtgatccacccgcctcggcctcccaaagtgctggaattacaagcgtgagccatcacgtccagcctttttttttttttttttttttttttttgagacagagtctcactctgccaccaaggctggagtgcagtggcgcggtctcagctcaccacaacctccgcctcctagcttcgtgtgattctcctgcctcagccttctgagtagcgacgattacaggagcctgccaccacccctgactaatttctgtatttttagtagagacagggtttcaccatgttggccaggctggtctcgaactcctgaccccaggtgatccacccgcctcgcccggacaaagtgctgggattatcatgccagcctttatcattaatttttaagaaaacctggacgggcacggtggctcacacctgtagtcctagcactttgggaggccgaggcgggcggatcacctgaggtcaagagttagagaacagcctggccaacatggtgaaaccccgtctctactaaaatacaaaaaattagcctggcatgatggtgggtgcctataattccacctactcgggaggttgagacaggagaatcacttgaacccaggagatggtggttgtggtgagccaggatcacaccactgcactctggcctgggcggctgagcgagactccatatcaggaaaaaaaaaaagaaagaaagaaaaggaaaccataatcttcgcaaaatttctgcctatgtccctcccttctccccattgggcaggggtgggggcggggactccaccatgtaccttgcacgatcatagagcctactggaaggaagaacgtaaccattgcatgatttatttttgcgcttgccgtaggtaatacatatgttgttgcttttttgtttcttgagataataatgaattaaatattaacaccatgaatatgattaatagcatgtaattttttttcttttgctgttttttcccctgctcttctcttctcctgtttttgtgcttttcctgctttttctttgtccccttcacgtcccttccatctcttttcctttgcctgctcttccctgatttacccacaaccctaactttgcatattcaaagggggagatcctggtaagtacatgcttagtgtggtagcaaacattagagaatctagtggtgatggagaccccgcccacccctaatattccctgttccccatcccctccaaataacaaaaatactaaaaatcgagctaacctggaaaccccatgccgcagccggcgctggactgcacgttgccctgggtataagtcgactcacacaggcactaactggaccgccacccttgaaggcgcacttctgcagccagttcctggcaggttttcctggtttcctgtaggtcagggatggcaaatacttacacaccgcccctgcctcccctcacatccctggctgtggaagatctcgcttaagccagaccagaattcattcttggcactgcccctcctccttctatctcctatgcagatgtcactcatggatcagagcatatttttccacatggcagaaatcttgccctcttgtgcccatggcagacatggctagttgatctagcactctttgccttgtgccgctcctctagcacacgcccatggcagacattgctaagcaatcctagcattctttccaaataagcttgccagcactcctgttctatagcagatgtggctaagtgattaaggtattgtttttctccctatatgataccctcttctctatgcatggcaggcatgactagtcaatcaggagcctctttcctagatgctgcctcttgtcctccagataaattgatgaggctcttctgttccacttaccctttctcctatccttggcctgtgacaggcaacactaattgatcctagcaccgtttcctgccacgcccagaattctcaccacagtgcttcaggtatcttgtaccagtcgattgacatggctcccgagatgaatcatatttgctgtccatccctgctgtgggtaacacctccttcctttgtgcagaaccctcagctggggcccagtgtggggcgtgagatgggcgtgaggcccagtccagcccagcccagcgggaagcagcctgctactcatagctgagaactgaacccagctcaaggagctcacctctaggcagccggcctcagcccggctcttacacttggacagcacagcctgggcctccagtcctagcaggggctcccttttgctggacattctcccactgccagccaccaaggcgctggtcatccctgccactgccctctggcggggctcttctggcaatcccagggtctttcttgtagctgagccgatcctatgccagggcctcgctgctcccagggcctgggtgtgcagatagggccatgggtggggcagtgacgggaggaattagttggcctcgggcttgtggttttcaggttcctcatgtgttccccccagtccctttgaatttgccaggccaagaccaggaacctgcttctcccttgtaccccaagaggtttaggggttcctcttttcctaccagaggccacatagcccagccccgtcatgagcgtggccgtggcctctgggtctcccatctgtggttcccatctctacccgggagactcaggccaggaccctcacccaggaaagagactggagcagcctgccagaggatccctgctttgccgccccctgcctgccctgccacccataccgccccatgtgcctgcctgcctgtcactgtgcaccctagcccgcaacggcctgccgcctcttctgtctctcccacccctacttccttctaagcccagtcccattgggatgtgtcccttggatgcaaacctgactttctgctgaggcctggctgctccctttctctggctcacaagtggtggatggctaacgggcctttgtttgccacccacagcttgcagctccctagggtgggattttgtctctgaacccgtgtggagaagggcacctcagggcttctgccagacgtcctgccccaaggcttggtgtgccatccccagcatggccccgatcagtgccctggccctgtggccatgcaccccaaagtgtagcgtgggccctgtgctccagctctgaccaacactaaccccggctggaggcaggagagccaggccaccgaggggtgtgcgggcacatccctctccttagaaaccgggccaggcctaggagtatggaggcctcacatttctctgggggagcaccgacagcctgtctccctgttttccctcacctggttgtcattcagtcatggaaccagggtctactaagcactcgttctgtgcccagctctgggctgagacaaggcagtgcccccaccccgctccccccgggtgaatggaggcattcccagactgccagacctttggtgctaacaccaggacgtcctggacagaccaggaagagctcgtcactgcgttcccagaggggatgctgtgacctcacaggggctgctggcctcagccccctcacccaccaccaggcagcccgtgaatggccagatgccaggggtcactgcctgctccaaacaactgtgagagtcctgtctgctcatcccagggagggataagtctgtacccttggccttaacaaggggcgcccggtggcatctcatgctgtccccagcctgggcagtgacttctgcatggtccaggggtccctgggtactctttagccacctccgtcttcatggccacctggggcttagcactcacatccagccaccaaggagccgctggagctgtgggctggtggccctggttcagaatgtcaggcccggggtgggtcggggtagtccggatgaagcccctccagaggaccgcccccgactaggacagcatctgggccccagagggattcctggaggccccatctctggcgctcctgccgtgccgtgccctgccatgccctgcactgggggatgcaggccagcccttcgcagctgtccatggccatgctcagcccaccctttgtagcttggccaagtctgtcagtgcctgggtcccaggccgccctgtgcgtgcctccgtgtgcttcctgcagctcccagggccctcgtcctgagtggggtggggggctctgcccacacatgcctccagcggccagggagcatgggagcacagcccccaggctgcctgccgttagttgtcaggtgagtccctgcgcaggcctgggttctgacccccacgcagatgacagctacagccacacaatccccatccatggggtctcccagcctgaaaccctgatgtgtcagtcaaaaggatgaccaccaggcttgcagccagcttgggacatgagccgcgctccttcaatgtccttggggagggcccctgggctcacacctttgaccctagccctctgtgtggatgctacccttggaaccttatctcacgcaaacaagtgcagttcctcagatgtcacatttcatgtgccacagccccacacacaagccccagggactcctcccatgggcccctttccatcaggcctctgtgagtctataccccatcagcccctggcccagtgagtctgtctgtccgcccacctgcccaggtggcgcctcatgttggtttcctgctggaaatgcttgggacagggtggaactgggtttcctgggctttggggctggaggtgtctctattgcggtccctggcttcccactgagctgtgggcaaggctgctgcgctgggggatggctggggcacggagcgaggttccctgctaagctgcgcgctttcccccaggtgatccgcaggggctggctgaccatcaacaacatcagcctgatgaaaggcggctccaaggagtactggtttgtgctgactgccgagtcactgtcctggtacaaggatgaggaggtgagtggcaggcgggagcagggctgctggggtaggtggggcagccagggaagagcgggtgggcgctccctctgggcagaactcagtcactgcgccactctgccctgagtcaccattaggactgtaactcgccgggcacggtggctcccgcctgtaatcccagcactttgggagggcgaggcaggtagatcacgaggtcgggagtttgagaccagcctggccaacatgatgaaaccccgtctctactaaaattgcaaaaattagccaggagtggtggcacgcgcctgtaatcccagctactcaggaggctgaggcaggagaatcgtttgaacccgggaggcggaggttgcagtgagccgagattgcgccactgcactccagcctgggcgagagagcgagactccatctcaaaataaacaaacaaacaaacaaaaaacaaccgtaacccagggctggagagcagccaccatgtgccaaaaggcttacattgtacctggcccccatgggaccagctcctagagtgcaaaagggagatggagggtgatggagtcactagcaggctagaaacaggccctgacctccagtgccactgtgactgccccgtgctcaagagaaggggccatgcccaagggtcaggggctcaggcatgcagccagcctccaggggcaccggggttccatcacttacacctcagtcaggccccttgcctctctgggcctcagtttttctatctgcgaagtggtctaggatggtccctgcccactgtgcggtgcttggccacagtgtgcagaacgatccccacatgctcgtcattatgggaaggaagtggagaggcccctgggtgatgactgcagggagcagtgttgagtgctgagtcatgggagggactcgttcactgcgagtgagggggcaggccttgagcaaggatactgccaaccggcctctgctctccatgctgacccagcatccctcctgatggtcctatgtagaaaaagatacataatgtttgacatatttatggggtccctgtgatgttttattagatgtacagagtatgtaatgatcacggcagagtgtttgtggtgtctgtcactttggtattcctcattttcctgtgttcagaacagttcaggtcctctcttctgactactttgaaatacacaaggctgggcacggtgcctcaggcctataatcccagcactttgggaggctgaggtgggaggatggcctgagttcaggggttcaagaccagtttgagcaacatagcattaccctgtgtctattaaaacccaaaaaaaattagctgggcatggtggtgcatacctgtagtcccagctactcaggaggctgaggtgggagggtcacttgagcccaggagatggaggctgtggtgagctatgatcacaccactgcactccagcctgggccacagagcaagacactgtctcaaaaaaaaaaaaaaagaagaagaagaagaaatagacaatacgttgttgcattgttggctgggcacagtggctcatgcctgtaatcttagcactctgggaggctgaggtgggtggatcacctggggtcaggtattcaagaccagcctggccaaacggtgaagccccttctctactaaaaatgcaaaaattagccaggtgtggtggcgcacgcttgtaatcctagttacttggggggctgaggcaggagaatcaccggaacctgggaggtggaggtggagtttgcagggagccgagatggtgccactgaactccagcctgggcgacagagtgagagactccctctcaaaaataaaaacaggctgggcgcagtggctcacgccattaatcccagcactttgggaggccaaggcagacagatcacttgaggtcgggagttcgagaccagcctgaccaacatggagaaaccccgtctctactaaaaatacaaaattaatctggcgtggtggcgcatacctgtaatcccagctactcaggaggctgaggtgggagaatcgcttgaacctgggaagcagaggttgcggtgagccaaaattgcgccattgcactccagcctgggcaacaagagtgaaagtgtgtctcaaagaaaaaaaaacaccagacaattgttgttaactatagtcttaactgcagtcaccctactcttctgttgaacaatagaagttaatgccttttctctaactgtatgtttgtacccattaaccccacctctctttaccccctacttgtccccacctttcccagcctctagtatttatccttctactctccacctctgtgagatccgctcttctaccttttatttttttagctcccacgtatgagtgacaacatgcaagatctgtctttttgtgcctggcttatttcacttaacataatgacctccagttccattcatgttgctgcaaatgacaggatctcattcttttctatggccctgatcaacccgtttcttgcttaattctcttgacgtaaccatggcttagtggcctggaagggaagccacttctgtgtgatagcttgttgctactctgatgcggtccaggttggctttcaagagtccctggcaaagagagctgtgtttttctcattgtcctggttgctctgggagaagactgcaggctgtcctgtgagccatggctgtgttatgtgggcaatggatttgcgtctgtaacagaggcccaaaatgaaggctcttaaagagatgaagtctgtttcttgctcacgtctcagtgagcttggtgaccctgtgctgcaaggctgtccagggcctggctccgcgtctcctgttgccaccttaacacagggctcccttcatagtttaaaatggctgccccatacccatcaccatgtagcctctagcagcccaagaagggaaagaagggcctctgtgtgtgggaactgtgagtccagctaacagttctagcactttctaagaaggaagtggatattggttgtttctgagcgtgacagctggggcttgacacccggaagtcaccaggatattggttgggtggtgtcaacccttcgtgtctcgtctccccacctataaagtcaggactctggcctgtcccctctggactgcgggaaccagtgggggaattctggtacttgagcccaggactgtgcctggctcactgcatgtgtcccaggttttgtcctggtaactaccagcatcaagtcctcccagctcctctctgtaggagggaacctacccacctacccccagtgcacagaggaggagctggaggctgtgtcaggtgcagggccagctggccagtccccatggtccctgggatggcacagccaccaactcagtccaggcaacctcagtggagaggctggggttgcctgaggcccctggagccgccctgcctggctctcttccccttgggtttgggggaatgctctgtaggagtgccccccactggggacttgctggcacccaacccagccccaggataggcaggactgggcttggaagtcccagacttagagagaaggcaggctggggggccccggctggccccagggagaagcaaagagaggcgggcctcttggctatggacccctgctctgtgctgggctcattggctaagagagcccactgaggccacacctgaggagaaccctactccccgtgaggaaaccctcacgcttgctattcgggtggctctgtggtcacccccatctaaggctctgagcggtgacttgccccacatcatggagcgggggagggtccccctggggtggaggcttccccagtgcacgtctgcgggcccatgctccctgacctgagggacaccccagcccgacatccgaacacctccgctgcagcccaggcctgatgtccccttgactgaggacattgggggtgaaaggatcatcccgctccacatgaggccagacgctcatctctggaatgttcctgaaacctcaggagccctgaggcttctgcgggactctggggcgctgtttctaaacccagggtggtggagtctgctgagccaccatacaagcatttctggggtccctgtggaagcttccagaacctcagatccagcgaacctcatggggttgggatgtgggaggagtgtggagccaggcgtggtctgcagccttctccccgcctcaggcacctctaggaactcacgtgtccagatcggatggctcctcaaaatggctggggtggggtagggtgccctttctctttttctcccctctttccgccttgcagtgagaaaccagcctgcgctgtggtgtgtgggctgtcaggccggctgagagctggtgccctgcctttcagttcagggctgtggggaccttccagggtcccctgggtgggaatgccaggcctggggcagcgagccttggaggagcctctgggcctgaacctcagcctggcagctctctgcctggcagcattgcaagtctagttttcagatctcctcttccttcacgtgaggggcccttcgtgtttttctcatctgagagttgaaagccagagcccccgaccctcccgtggagccccacactggagtctggagcagcagtgggagaagggccgggcgccggccgtaatgagaaacagccgacctgtgaaaggggccctgtgtgagccccagacacaaagcaggctccattcaggagggggcagccatggaacctgacccccgccaccacccaagttaggatcccagcagggacccttggagtcacacacgtggcagccacccctgaggaggaggccaccctcttagatgcctcagtgagacacaagacatcaatatctctttatttaaaaaataaacaagacatttacagccatggggtggggatggcagactgatagggccagggcctccaacccctcggccggcctcggggctccctctgcctttccccagtgcctcttctcccacccaggccctcgaatcttctatgcgaggctctgccacagtgggaaacggggtggtggaaaatgacactcacctgccggcgagtttggggggcctgtctcgacgagccgctcacccaagcccagcctaaccaatgtgcagactactgtacacattgagagcctcctgaacaggtagtctgaacactgggttggcggggccggctatccatcctgcagaaccccccaggcagacgctggggccaccaggccaggccgtgcctcagcacctctgagcagccaaggaaaccaccactcttcccgagacgatccgctctgtcccttctgacgtggcaaggctggggccggctcgcatctggagaaagttctgggttttcaggaaatcctaaagagtgggggaggcggagcaggaggcagggtttgggatcgtggcttctgggctcaggaggaatgtctgactctttgggggtcgggggtggggaggaggggcgcacacacacgtgtgtgtgtgtgtgtgcgcgcgcgcgcacgcgtgcgtgccggcagcaccaggaaggcggccactgatttctcggcggaatcgcactgtaaacagttccagatgtggcattagctggaatggcctgtgactcagttacttggccctgctggctggaagcttccggccgcgtgatatgatagggtcagggcagcaaaggcccttgggcaaacgtccgagccgggggcagggcttctgcagagccccctcccctagccccttctaaagcccccaaaactcttccccgaaaggtgggagggacccaggccctgtgttacccagccttgcctgggatgacgggtgcaggctttcttcatcaccttccctcccttgggtccgcagcggcatccctccctccatggccaccgggcccctctcctatgctctgctccctccatggccaccgggcccctctcctatgctctgctccctccatggccaccgggcccctcttcctatgctctgccctacttctttgcctagagcctggcaggctaatcctggagccgctcacaagagcaaccaaagaaaatcccgggtgctcatgggcaccagctctgcagtgggcaccaagctcctccatcctccttggatagatgaggaaactgagatgaaatgggaggtggcggggaagtggcttgcccgagggcacacggccaggaaagggcagggctggcatcacctcaaccatgctgagctcctaacgccctgaggctgagcccatgtgccaagcccactgcttcatcctggctccccttgcaaagtcctgacagtcccagctggcccccacttgccagggagcccccgctgccttctccacagtcactgtggctgctcctgaacttggaggcggcagccaggttaggctttgtgctggggcagcgcagtgaggggacatgagaggagtttccagagacggcccagggagaagaagggccaggggcactgtggggaggactgggctttgggtcacagagacctggcctctgaagtcctgctgtggcttgcgctgcctgccgtgtggccttcggcagccagcttccctctctgagctaggagggatccgtgaactgagaccaagcagtgcatggcatgggtccccaagagctgctgctgtggcgggtgggcacacacatcactgggtgagtgtgggactccagggtgccacccccagctccgtgactcgccagccccttgcccctggccgaggggcccacctctgagctgcctccctagcagtctggacagccgtggctggcacttggtgcttcctgaacagggccaaccttagaaagcaagtgatagggcaggtgcggtggtgcacacctgtaatcccagcactctgggaggctcgcttgaacccaggagtttaagaccagcctgggcaacatagcgagaccccatctctattaaaataatgataatgataataataaagaaagggagtaaggcttctgcagcacctggcccaggacctatccagccccaagatgtcctaaagcggccaaggttgaaatcccagccctgctcctctctgcctcagtcttcccctctgtaaaatggcatcacagaggtaactcactcctaggctcgtttcaaagatggagcccagataaaagttccattcacttcgtgcaaggcgaggggcagttgtgttgtgcgtgccgtcagccacatgtcagcagtgaactcaacaggagtccctgccctggagaaacttgagtcagtccagtggcagtcagccacctaggtcaataagcacaggcagtcaggcacctaggtcaacaagcgcaggatacgtgacgtgttgtgtgagggaaaaggaggatggaggtggggagggtgcgggtagagttagggcaggagggagccatgcaagtgtcaggatcaggcagtagcccggtcgtccgaaggccctggggtaggaacccaggtgggatactcagggagcatcatggagggcagcgtggctgggacagagtgacggacggggaagggccggcagatgggctcatatacagcagcgaccagcattgagaagcccccggggctggtggtggcgcatgctacacgctctggcctggggcatcctgagttgtcacgtggaccgctcagggtgactcttttccctccaccctcaggagaaagagaagaagtacatgctgcctctggacaacctcaagatccgtgatgtggagaagggcttcatgtccaacaagcacgtcttcgccatcttcaacacggagcagaggtgaggggcccaggggcctggggatggctcggggtgaagaccaatggcctcattcacactccacaaccttcactgagcactgagcacctggctgtcagcagtccctgcccttgggacccagcttttagaaaggggagtcacgtgagaaatagcaaatgccagggatgcttcccgtgctgggtcagagatgacctctctgggcagagatgaggatgaaggcaggctccgagtcagtgggagccatggagagttctgagcacagggtgaccaggacctggctcaggtgcttgcaggagccctctggtggctgagagggaaacagtatgagagggtgagagatgggggacgagggcaaaggccgctgccttgtccaagtgggcgatgatggggccagaacccatagggaaggagggtgcagattctgggtagaagagtcaggcggagccctggtgggcatggatatgagagagaaaggcaccaattgtgaccctgagtacgtgggcctgagctcctgcactgcccagctgctgccattggccgaggtggggaaggcagcggcaggtaggcctggagacagccaagagctccatttaggccatgccaagggagagggtgcatcagggaggcacctgggtagatcgaggagtgtgatgtccaggaacgagctccagtctgggatgtgaactgggcagtcaccattgcgtggatggtatttcaaggaacgaaaccagatgagctcccaggagagtgaagctggagaatgggaggccccaggaagctcacagtacatctgtcccatgaggcgtagctggagactttagcagagacactgctctcaggaagaaacccagctggcaggagggctcttcccatgctcacacaatcacgctcatccaggaagcagggcccacctgagtcagggattagctgtcagtaaaggcccggtggtaccctgagacctgtaggcaggcactgacgtcctccctgctggccccagaacctccttgcctactgcttggctacacccaccaactccagctgagtctcctggttccctcctgctttgctctggctggcctaaagctcgagacccatttgtccaccagctggccgtgaaaaccttcatagctcttctaggcttgcccctggccatatgacacctggcagctgtcccaggtccctgagccgtgtgcctcctgtacagggagggtgacaatattatctgatatatcttttaagagcaggttcaggaaacccagagtagtagctgcaaaaacaagataagatggttgatagttttttgtgtaaattaagtccagactttagtatcccgggcaaagtggagcagctccacaggcatcagggtccaggccctgcatgttcctcaggattccacctgatatgcagaagccgagctctgcggtgggacaggcctgccatgaaatcctgactttttttttaaacggagttccgctgttgttgcccaggctagagtgcaatggtgcgatctcagctcaccgcaacctctgcctcctgggttcaagcgattctcctgcctcagcctcccaagtagctggaattacaggcatgcaccaccacgcctggctaattttttatttttagtagagacggggtttctccatattggtcaggctgggctcgaactcccaacctcaggtgatccacccacctcggcctcccaaagtgctgggattacaggtgtgagctactgcacctggcccaaaaccccgacttctacttctttgtccaaaatggctgcccagactccagccattgtgatgatgtcccaggcagcagcaggaaggagaggaggagctacaagggcatgcctctccccacacaacctcatccagaggtcgttcggggcagccacttgctgaccacaaacccaactctcacttaaaggctttgtgggcagcttggctgtcttaaccacacctggatgtgggacaggaaaatgtgcgtggcatgtggcacggggcctggcctgtagaccaccatctgcaagcactgtttagcatccattccatttatctcccagctttgagaccctggttcttttttctttttctttttcttttttttttttttttgagatggagtcttcctctgtcacccacccaggctggagtgcagtggcatgatctcagctcattgtagcctccacctcccatgctcaagtgatcctcccgcctcggcctcccgagtagctgggactacaggcgcacaccaccatgcccagctaatttttgtattttctgtagagatgggggtgttgctgtgttgctcaggctggtctccaactcctgagctcaagcaatccccctgtctcagcctcccaaagtgcaggaattacaggtatgagccaccatgcctaaactttacaaaaatttttttgttttgttttgatacatagtctcactctgtcgcccaggctggagacagtggcacaatcttggctcactgcaacttccacctcccaggtttaagcgattctcctgcctcagcctcccgagtagctgggattacaggcatgcagtaccactcccagctaattttttgtattttagtattgacggggtttcaccatgttggccaggctggtctcaaactcctgacctcagttgatcctcctgcctcagcttcccaaagtgttgggattacaggcgtgagccactgtgcccagccaaaactttttttataaaaaacacacaggccgggcacgggggctcacgcctgtaatcccagcactttgggaggccgaggcaggtaggtcacgaggtcagaagatcgagatcatcctggcgaacacggtgaaaccccgtctctactaaaaatgcaaaaaattagctggggtggtggcaggtgcctgtagtcccagctactcgggaggctgaggcaggagaatggtgtgaacccgggaggcggagcttgcagtgagccaagatcgcgccactgcactccagcctgggcgacagagcaagactctgtctcaaaaacaaaacaaaacacattcgggcacagtggctcacacctgtaatctcagaactttgggaagccgaggtgggcggatcagctgaggtcaggagttcgagaccagcctgaccaacatggagaaaccccatctctactaaaaatactaaaattagccaggtgtggtggcgcatgcctgtaatcccagctactcgggaggctgaggcaggagaatcgcttgaacccgaaaggtggaggttgcggtgagccgagattgcgccattgcactccagcctggacaacaaaagcgaaactccgtctcaaaaaaaaaaaataaataataataataataataaagttctggtggacagtgctgctctgggctttcctgaaaatgccccagtgggagcttcccagccacagttggtgtcgagggtcacatgcccacctctgggggcccaggaaaagagaagagtcagctgatccaacagaaacaaagaaactcagacacttgccgagcttgtgcacagcgctcttctgtgtaggcgtcactcacggtgacccctcagcatgaccaggtgaagcctgggttgggtttgggttcctgatcagtcagaaagacccctagagcccattcctctcggcagtctgccagacccatggcagggtcaagcttgtgcccctccttccccacccccccgcagaaacgtctacaaggacctgcggcagatcgagctggcctgtgactcccaggaagacgtggacagctggaaggcctcgttcctccgagctggcgtctaccccgagaaggaccaggtgaggagccgtcctgcgcagccaggcccagagcccccacctgggagaggaagcagggctggctttccccaggacaggtcattttcaggccatgttagccaggagtctctgaaatcatgtagcagatgcccacttgagcaagcaaaggagaaattgggggtactttgtcatcagggcccagaaagttccctcacggaagccagtgaccggggcacacaggggatggggtcccacttgctttgttctcttctcttttccccttccatcctgaggtagagtgaacatggccacccttggccccaatattaaaatgccttgccgggcacggtgggtggttcgcccctgtaatcccagcactttgggaggctgaggtgggcagatcatttgagctcaggggttcgaaaccagcctggccaacatggtgaaaccccgtctctactaaaactacaaaaattagccaggcatggtggtacgtgcctgtaatcccagttactcaggaggcttaggcaggagatcgcttaaacccgggaggtagaggttgcagtgagctgagatcacgccattgcactccagcctgggcgacagagcaagactccatctcaaaaataaaataaaatgtcccaaggttgggtgtggtggcttacacctgcaatcccaacactttgggaggcaatgtgggcagatcctttgggcccaggagttcgaaaacagcctgggcaatgttgcaaaacccttctctccaaaaaatacaaacatacccaggcatggtggcgcacccctgtaatcccatctactccagggcgctgaggtgggaggatcacttgagctctccctgggaggttgaggctgcggtgaactgtgtttgtgccactgcactgcagcctgggtgacatagcaagactgtgtcaaaaaaaaacaaaacaaaaaaacaacgttccaatgcccaggtgaggggatccaccccagcatcagccagggtcaccccattgtttgggcagctctggcccagggcaagcaggcctatctggtgccagtggggctgtcaggggccagcctgaggtcagttattggtgggacaatagggcagatggtttccagagaaccaggacttggcccaggccacagtcacccctcagcacctcccctcccgcttgcaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatgtgagtggagaactaaaaatgagaaggaggtagctgggtgcggtggctcacgcctgtaatcccagcactttgggaggccaaggcgggcggatcacttgaggtcaggagttcaagaccagcctggccaaaacggtgaaaccccatctctactaaaaatacaaaaattaggctgggcgcggtggctcacacctgtaatcccagcactttgcgaggccaaggcgggcggatcacgagctaaggagttcgagactagactgaccaacatggtgaaaccccatctctactaaatatacaaaaattagccgggcacggtagctcacgcctgtaatcccagctactcaggaggctgaggcaggggaatcgcttgaacccaagaggcagaggttgtggtaagcctagagtgcaccactgcactccagcctgggcgacagagtgagactccgtctcaagaaaagagagagagagagagagaaaaatacaaaaagtagccgggcatggtggcgggtgcctgtaatccagctacccgggaagctgaggcaggacaattacttgaacctgggagatggagatggcagtgagccaagatcgtgccactgcactccagcctggttgacagagcgagactccatctcaaaaaaaaaaaaaaaaaaaaatgagaaggaggccaggcaccctaggccatacctgtttgtagtcttagcactttgggaggctgaggcaggaggatcacttgagcccaggaggttgaggctgcagtgagctatgatcatgccactgcactccagcctgggcgacagagcaagaccttgtgtccaacaacagcaacaacaaatttgaatgaatcaccaccctttgaacaccagaatctgcacggccatcctctttgggaaaccctagggtttccgagccacactgggtccatagtcccatcaagtccactaactggagtgaacactgcaggtgtgcgccttctctgaattaacttaggctggcatcagaataactgcaggagggagaacggccatcttccccatttcacagacagaaaacaaggccagagagatcaagtaacctgccccaagttccttaggaaagtgggaagtgggattcaaacccacgtttaccctggttgcaaccatacccttgggttgtgttgggcagccgctgtgtcctaatgatctggggcccagcctcttcctcatgggcgtcacccgcctggccccgggttccctggagactctcagggctctgggctcctcttcagtgaaatgcagctgtactgatagtatctccagctcaggctgctagagggctcagggcacttgtgtatcaggcctttggcatggcactagccactcaggaagctttataaaccagctttggggccggagcagtggctcatgcctgtaatcccagcactttgggaggctgaggagggaggatcacttgagcccaggagctgaagaccagcctgggcaacatagccataccccagtctctacaaaaaatttaaaaattagctgggcgtggtggcaaatgcctgtagtcccagctactcagaagaccgaggtaagagcatcacttgagcccaggaggttgaggctgcagtgagccatgattacgccactgctctccagcctgggtgatggagcaggaacctctttcaaaaaaaaagtgtcttgggttttgtatatgaatgtcaaccacagaaacctgcggatctaagtaaaactcccacacagggtgtggctgggcatggtggctcacatctgtactcccagcactttgggaggcttggcaggaggatcactcgatcccaggagttcaagaccagcctggacaacatagtgagaccccatccctatttaaaacacacacacacctcccacgtgccatgccctcccaccctgttgctcccattctcagtagtgatcagtgttcacagtttcatggtgtcctggtatgtttcctcatataccgataggatcggagacatatacggttcttctgctatgaaatttaaaatgcatatatcctttgaccctgcaagtttacttttaggaacttctctaagagagacaattgcccacgtgcaaagtgagcttatacatgcttattgttttccatgatgttttatagcagccaaagatgggacataattatccatttttaatagactcttataaaataaaaatattttattatttaagaaaataataaatctgtcggcccagctactcgggaagctgaggcaggaagatcacttgagcccaggagatcgaggctgcggtgagcaaagatcgctccactgcattccagcctgagtgataggagtgagaccctatctaaaaaaaaaaaaagttgtgacggccaggtgtggtggctcatgcctgtaatcccagcactttgggaggctgaggcgggcacatcacgaggtcaagagactgagaccatcctggccaacatgctgaaacccccctctactaaaaatacaaaaattagctgggcgtggtggcacgcgtctgtagtcccagctactctggaggctgaggcaggagaatcacttgaacctaggaggtggagtttgcaatgagcggagatcatgccactgtactccagcctggtgacagagggagactctgtctcaaaaaaaaagaaaaaaaaaagtaactgaaaaacttctgtatccagtaggaggttccagaaaggacaatgtataaaattcatgaacagaaactagtagtgtttgaacagaagccaggtggaagatgtaacaggattagccgggcgcagtggctcactcacgcctgtaatcccagcactttgggaggccaaggcgggtggatcacctgaggtcaggagttaaagaccagcctggccaatatggtgaaaccccatctctgctaaaaatacaaaaattagccgggggttggggggcacgcctgtagtcccagctacttgggaggttgaggcacaagaattgcttggacccaggagacgcaggttgcagtgagccaagattgcactgcagcctgggtgacagagtgagactctgtcacaaaaaaataaagatataacaggattggctgggcgcggtggctcacgcctgtaatcccagcactttgggaggctgaggcaggcggatcataaggtcaggagatcgagaccatcctggctaacagggtgaaaccctgtctctactaaaaatacaaaaaataagctgggcgtggtggcaggcgcctgtagtcccagctacttgggagactgaggcaggagaatggcataaacccgggaggcggaggttgcagtgagctgagattgcaccactgcactccaacctgggcgacagtgagactgtctcaaaaaaaaaaaagcaaaaacaaaaaagatataacaggattattctgccaaggttaaggaaataaataaataagctaaaacaggagaaaagacatcaatggaagaggcaagatactagaaataagttgaataagaatctcataaccagcctgggccacatggtggaaccctatctctaaaaaaattacaaaacttagccaagcatggtgtcaacgtgcctgtcgtcctagctacttgggaggctgaggcaggataattacttgaacccgggaggcggaggttgcagtgagctgaaattgagccactgtactccagcctgggtgacagagcaagactctttttcaaaaaagtctgggggtggccccgccctgtgagagatgtttttccagcagtcactgtgggttctgggttggggtgatacacaagcctgaccctccccaacccctgcccgcagacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacaggtccggaagcctggttcccctaccctcaagcattcggcctgcaggttcctgccctccctgtgtgtcctgcagggtcctggcaggaaacaggacacagcccaagggtggcacccagggctgggcactgtgggagctgctgccctgctgaggccggaggagggagagaaggggtatgggggcgagccagccctacagctctagggcaggaccctgtgaataaataccccgcctgccctctgctggtgccttccattggcacagcccaaatggaagctggggtaagaggctggaggggcagcagccacaggagagagatgagcctcctggagcacagagaagggcagatgggaggctctggaggggcaaacgcaaggcgtggccagagctgctgccgcccctgagttgtccattgaggccgtcgggcagggaacctcagagggggctgccttgcagagccctgggggagccatggagttccttaaggggaggatatcgcacccaggcctgcaggtggcagggactgaggcccaggagggaatctggatgtctggacagggcttgcaggttccacggcccctagagatattagggcttgatctggaggactctggaagtgtctttggctgtgagggtggatcccaggcccaaggcctgagggggccctgtgagtgggaagtgcctgagggggccgagggcaagggaaggtgggactggcgctcaggttggggtgggaggatcccactgcgcctgcgctgtccccatagccagcccccacctcaggttctggcagccacagtggcatggcgggggctcctactccatctgtatctgtagctcacaccctctccttcctcacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccaggtaaggccaaccccctgccctccaccccaactgcctgcaccctggggtctctcctcctgtctcacttcctcccagtgagctctcactacgtgcccagctgctggagtggaggaatcgtcctcatccctatttggcttgcgaggaaacaggcccagagaggccaagaggcttgttcagtgtcacagagtagcggagccctggtgactccggggctcccagcttgccctctgcctactggggtgtgccaccaggcagctggggaaccctcacactgggcacctcctcccactgtttaccttcttctccttcctgctcctgcctgcctcaacctaccgtgggccaggctttattctccccacttctccggtggggaagctgaggcccagggagggcagggggctcactgagggtcaaacagcaggcgagttgatgcctaggtttggcactcctgcccgacaccctggtggcttgcggaggtcagcctgggaacaccctggggtggtgtgtgggtgggggctgggtcctcaacccaggcctgcctcttgctcccggcctcactgccgtctccccctccccacctgtctttattctctttgcagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtggctgctgtgtgggcctcttgtgttagtgttcaggctggggacatgggtgccacctccatcaggcctcccataaggatgcccaagtccctgcactcataagtgcctcccatctccctgagggctctgctttcgggggtgtcacctttcagaggaagccactcgatacaggggagagcttttactttccttagcatgtgaggagtgggagcagatattctctgaccccctgcacacccccacgtgcacaggcctggctgctgcctggtgaagcggggaccccagcgctccacccccttcctaccctcaggccctgcttctctcacctcgtggggaagcccaagcctcgtggcccaactggggctcagttaaactttgctttctgatttttctcttgtgccaggcgaccacctccatcggctcccgcacgacctttcttctgagcttcgtgggaggcccctcccacctgtctggctgccccctcgggggccggtctgtcctggctggtgtccctgagccccaatcagcaggctcttgtgattttctgaccataatttattgactccaatgcccaggccacaccaccctttgttataggaggcttctgcctagactttggccgggccatccctcatgcctgtgtggggcccctgcaggagaggggccggggcaggtggtcttccaggcccccttcctggcattctgttaccagacctcaacctggcttggagggcccaggtttccttgttaggccctgccccgcaccaggcaacgctaacacaggatgggaggcttaggctaaggcacatttacagtagaggggccaggaaatccgaggctcacgttccaacgctgcagtgcccaccatgtgagatttccaggaccgtcggtgcagccactgagccgtcccttctacaagccagaggtgttccctgcccgctgaggacggaaggagactcatggggccagaccgcaggccctgactgcacactcccgttttggcaggaaactaaaattggggagggacccccaagtctcatatgcacacaccctgctgcccctcctttgtcccgttcttccttccatggcaggggctacgtgggcaccgggcgcttgtcctggaagaagcgcttgagcgtgcagacctgcagcacagccaccagcagcagcaccgccacgttgacagctgaccagaagttgacccgctccaagttgccctcttgcaggttgcggtcacgtgcctcgaaggcccgcagtagcgtgagcatctggatgctgcgctccagccgggtccgcatggtctcaatggactcctacagggcagcgggaggggaagggtcaggcctccctccacccatcagggagcagagaccaaaaaaaccgggggatacggagggaggctgtattaaccctgggaggtacagctgcaaacacagacttgttcaggctaagttcaaatcctcaccctgccactcactggctgtgaccatgagcaacttaattaacctatctgagcctgtttcctcttctataagcttccaaattgctgtgaacatttaatgcctaaataaatgtacaaggatgagcatggtggctcatgcctataatcctagcactttggaaggctgaggtgggaggatcgcttgagcccaggagtttgagaccagcctgggctacatggcaaaaccccatctctacaaaaaattagccaggggtggtgatgtgcaactgcaatcccagctactcaggaggctgaagcaagattacacctgtaatccaaacacaggaggatcacttaaacccaggagttcaagaccaccctagccaacatggtgaaacctcgtctctacagaaaacaaaaaattaggcatggtggtgcacacccgtagtcccactgaggtggcaggattgcttgagcccaggagtttgaggctgcaatgggctatgatcacaccactgcactccagcctgagtgacacagcaagaccttgcctcgccgtagctcacacctgtaatcccagagctttgggaagccaaggcagacagatcccctgaggtcaggagttcgagaccagcctggccaacatggtgaaaccctgtctctactaaaaatacaaaaattagtcagtcaggcgtggtggcacagctattcaggaggctgaggcaggagaattggctgaacctgggaggcagaggttgcagtgagctgagatcgtgccactgcaatccagcctgggtgaccaagagagatctgttagaaaataaataaataagtagttaattaaaatactaataaatgtacagaacatatttgcttgtggttaagagcatagttgctgaaaccagcatgggttcaataccaactctgctagttggtctgtgtggccgtgagttgctcagccatcttgtatctcactttctccacctgtaaaatggggatgacttgagcacagggtctgcttcacaaggtggtttggagatttacggtatgagttatttatgatatgagttccttaaacctttacaccagggtttatacctagaaatgaactacttttttttttttttttttttttgagacggagttttgctcttattgcccaggctggagtgcaatggtgcgatctcggctcactgcaacctctgcctcccaggttcaacttccacctcctgggttcaagtcattctctggcctcagcctcctgagtagctgggattacagacgcccgccaccacacccggctaatttttgtatttttagtagagacggggtttcaccatgttggccaggctggtctcaaaactcctgacctcaggtgatccacccgcctcagcctcccaaagtgctgggattacaggcgtgagccaccgtgcccggcctgaaatgaactacttattttaagagctgctactcttactataattcagttggagggcacaactacggaggggaggctgggtcagcccaaggggggcaccccaggtgaatcctagagatctggaaggagtggccccagcgcagcctggacacaccttgatgtcctccattttaacatccagcatctcctcgggctccacagcctctgcccatccttcgacc

SEQ ID NO: 2 - DNA, 3672 bp, Homo sapiens
gaggtcgctcgggtcgggtgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcaggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtggctgctgaaaaaaaaaaaaaaaaaa

SEQ ID NO: 3 - DNA, 3684 bp, Homo sapiens
gaggtcgctcgggtcgggtgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcagggggagatcctggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtggctgctgaaaaaaaaaaaaaaaaaa

SEQ ID NO: 4 - DNA, 20 bp, Artificial sequence
  Primer
gacctcatgccaaagaccat

SEQ ID NO: 5 - DNA, 21 bp, Artificial sequence
  Primer
gtctgccgaggagtataggta

SEQ ID NO: 6 - DNA, 22 bp, Artificial sequence
  Probe
ccttcatccaccacgagctgct

SEQ ID NO: 7 - DNA, 16 bp, Artificial sequence
  Synthetic oligonucleotide
ctcaggcgacacccga

SEQ ID NO: 8 - DNA, 16 bp, Artificial sequence
  Synthetic oligonucleotide
gatgagggtcaagttc

SEQ ID NO: 9 - DNA, 16 bp, Artificial sequence
  Synthetic oligonucleotide
cttgatctggtactcg

SEQ ID NO: 10 - DNA, 16 bp, Artificial sequence
  Synthetic oligonucleotide
gtccgtaggccttggg

SEQ ID NO: 11 - DNA, 16 bp, Artificial sequence
  Synthetic oligonucleotide
accgatggtccgtagg

SEQ ID NO: 12 - DNA, 16 bp, Artificial sequence
  Synthetic oligonucleotide
aatggtgggccggctg

SEQ ID NO: 13 - DNA, 16 bp, Artificial sequence
  Synthetic oligonucleotide
acacacttcaaactcg

SEQ ID NO: 14 - DNA, 16 bp, Artificial sequence
  Synthetic oligonucleotide
cccgacccgagcgacc

SEQ ID NO: 15 - DNA, 16 bp, Artificial sequence
  Synthetic oligonucleotide
cacccgacccgagcga

SEQ ID NO: 16 - DNA, 16 bp, Artificial sequence
  Synthetic oligonucleotide
gacacccgacccgagc

SEQ ID NO: 17 - DNA, 16 bp, Artificial sequence
  Synthetic oligonucleotide
ggcgacacccgacccg

SEQ ID NO: 18 - DNA, 16 bp, Artificial sequence
  Synthetic oligonucleotide
gttctcaggcgacacc

SEQ ID NO: 19 - DNA, 16 bp, Artificial sequence
  Synthetic oligonucleotide
ccggttctcaggcgac

SEQ ID NO: 20 - DNA, 16 bp, Artificial sequence
  Synthetic oligonucleotide
catccggttctcaggc

SEQ ID NO: 21 - DNA, 16 bp, Artificial sequence
  Synthetic oligonucleotide
cctcatccggttctca

SEQ ID NO: 22 - DNA, 16 bp, Artificial sequence
  Synthetic oligonucleotide
cgccgcctcatccggt

SEQ ID NO: 23 - DNA, 16 bp, Artificial sequence
  Synthetic oligonucleotide
ggtcgccgcctcatcc

SEQ ID NO: 24 - DNA, 16 bp, Artificial sequence
  Synthetic oligonucleotide
cacggtcgccgcctca

SEQ ID NO: 25 - DNA, 16 bp, Artificial sequence
  Synthetic oligonucleotide
ctcacggtcgccgcct

SEQ ID NO: 26 - DNA, 16 bp, Artificial sequence
  Synthetic oligonucleotide
gcctcacggtcgccgc

SEQ ID NO: 27 - DNA, 16 bp, Artificial sequence
  Synthetic oligonucleotide
cggcctcacggtcgcc

SEQ ID NO: 28 - DNA, 16 bp, Artificial sequence
  Synthetic oligonucleotide
gctcggcctcacggtc

SEQ ID NO: 29 - DNA, 16 bp, Artificial sequence
  Synthetic oligonucleotide
ccggctcggcctcacg

SEQ ID NO: 30 - DNA, 16 bp, Artificial sequence
  Synthetic oligonucleotide
acgcccgctcccggct

SEQ ID NO: 31 - DNA, 16 bp, Artificial sequence
  Synthetic oligonucleotide
ggcctcggcaagacgc

SEQ ID NO: 32 - DNA, 16 bp, Artificial sequence
  Synthetic oligonucleotide
ccgggcctcggcaaga

SEQ ID NO: 33 - DNA, 16 bp, Artificial sequence
  Synthetic oligonucleotide
cgcccgggcctcggca

SEQ ID NO: 34 - DNA, 16 bp, Artificial sequence
  Synthetic oligonucleotide
ccgttgctccccgccc

SEQ ID NO: 35 - DNA, 16 bp, Artificial sequence
  Synthetic oligonucleotide
agccgttgctccccgc

SEQ ID NO: 36 - DNA, 16 bp, Artificial sequence
  Synthetic oligonucleotide
tgtagccgttgctccc

SEQ ID NO: 37 - DNA, 16 bp, Artificial sequence
  Synthetic oligonucleotide
cgtctgtagccgttgc

SEQ ID NO: 38 - DNA, 16 bp, Artificial sequence
  Synthetic oligonucleotide
aacgacctggccccgc

SEQ ID NO: 39 - DNA, 16 bp, Artificial sequence
  Synthetic oligonucleotide
accctcaacgacctgg

SEQ ID NO: 40 - DNA, 16 bp, Artificial sequence
  Synthetic oligonucleotide
ccgaccctcaacgacc

SEQ ID NO: 41 - DNA, 16 bp, Artificial sequence
  Synthetic oligonucleotide
cgccgaccctcaacga

SEQ ID NO: 42 - DNA, 16 bp, Artificial sequence
  Synthetic oligonucleotide
ccgccgccgaccctca

SEQ ID NO: 43 - DNA, 16 bp, Artificial sequence
  Synthetic oligonucleotide
tcgcccgccgccgacc

SEQ ID NO: 44 - DNA, 16 bp, Artificial sequence
  Synthetic oligonucleotide
cgctcctcgcccgccg

SEQ ID NO: 45 - DNA, 16 bp, Artificial sequence
  Synthetic oligonucleotide
tgcgctcctcgcccgc

SEQ ID NO: 46 - DNA, 16 bp, Artificial sequence
  Synthetic oligonucleotide
ccctgcgctcctcgcc

SEQ ID NO: 47 - DNA, 16 bp, Artificial sequence
  Synthetic oligonucleotide
gcgccctgcgctcctc

SEQ ID NO: 48 - DNA, 16 bp, Artificial sequence
  Synthetic oligonucleotide
gcggcccccggcccga

SEQ ID NO: 49 - DNA, 16 bp, Artificial sequence
  Synthetic oligonucleotide
ctggccgatggagctg

SEQ ID NO: 50 - DNA, 16 bp, Artificial sequence
  Synthetic oligonucleotide
ctctggccgatggagc

SEQ ID NO: 51 - DNA, 16 bp, Artificial sequence
  Synthetic oligonucleotide
gcagctctggccgatg

SEQ ID NO: 52 - DNA, 16 bp, Artificial sequence
  Synthetic oligonucleotide
gggaaggaagtcccgg

SEQ ID NO: 53 - DNA, 16 bp, Artificial sequence
  Synthetic oligonucleotide
attcctgaaccgcggg

SEQ ID NO: 54 - DNA, 16 bp, Artificial sequence
  Synthetic oligonucleotide
cgattcctgaaccgcg

SEQ ID NO: 55 - DNA, 16 bp, Artificial sequence
  Synthetic oligonucleotide
gacgattcctgaaccg

SEQ ID NO: 56 - DNA, 16 bp, Artificial sequence
  Synthetic oligonucleotide
gacttgcagtgcaaaa

SEQ ID NO: 57 - DNA, 16 bp, Artificial sequence
  Synthetic oligonucleotide
tggacttgcagtgcaa

SEQ ID NO: 58 - DNA, 16 bp, Artificial sequence
  Synthetic oligonucleotide
tttggacttgcagtgc

SEQ ID NO: 59 - DNA, 16 bp, Artificial sequence
  Synthetic oligonucleotide
actttttggacttgca

SEQ ID NO: 60 - DNA, 16 bp, Artificial sequence
  Synthetic oligonucleotide
cctgccggacttcatc

SEQ ID NO: 61 - DNA, 16 bp, Artificial sequence
  Synthetic oligonucleotide
tctcctgccggacttc

SEQ ID NO: 62 - DNA, 16 bp, Artificial sequence
  Synthetic oligonucleotide
caatctcctgccggac

SEQ ID NO: 63 - DNA, 16 bp, Artificial sequence
  Synthetic oligonucleotide
ttcaatctcctgccgg

SEQ ID NO: 64 - DNA, 16 bp, Artificial sequence
  Synthetic oligonucleotide
ggtcgatgagggtcaa

SEQ ID NO: 65 - DNA, 16 bp, Artificial sequence
  Synthetic oligonucleotide
cgggaggtcgatgagg

SEQ ID NO: 66 - DNA, 16 bp, Artificial sequence
  Synthetic oligonucleotide
cccgggaggtcgatga

SEQ ID NO: 67 - DNA, 16 bp, Artificial sequence
  Synthetic oligonucleotide
gatacccgggaggtcg

SEQ ID NO: 68 - DNA, 16 bp, Artificial sequence
  Synthetic oligonucleotide
gtgatacccgggaggt

SEQ ID NO: 69 - DNA, 16 bp, Artificial sequence
  Synthetic oligonucleotide
cttggtgatacccggg

SEQ ID NO: 70 - DNA, 16 bp, Artificial sequence
  Synthetic oligonucleotide
aggcaccttggtgata

SEQ ID NO: 71 - DNA, 16 bp, Artificial sequence
  Synthetic oligonucleotide
gtccttgatctggtac

SEQ ID NO: 72 - DNA, 16 bp, Artificial sequence
  Synthetic oligonucleotide
atgtccttgatctggt

SEQ ID NO: 73 - DNA, 16 bp, Artificial sequence
  Synthetic oligonucleotide
aggatcatgtccttga

SEQ ID NO: 74 - DNA, 16 bp, Artificial sequence
  Synthetic oligonucleotide
ctgcaggatcatgtcc

SEQ ID NO: 75 - DNA, 16 bp, Artificial sequence
  Synthetic oligonucleotide
ggctgatgaactgcag

SEQ ID NO: 76 - DNA, 16 bp, Artificial sequence
  Synthetic oligonucleotide
gctctcccggctgatg

SEQ ID NO: 77 - DNA, 16 bp, Artificial sequence
  Synthetic oligonucleotide
gctgctctcccggctg

SEQ ID NO: 78 - DNA, 16 bp, Artificial sequence
  Synthetic oligonucleotide
gtgacagccagaatga

SEQ ID NO: 79 - DNA, 16 bp, Artificial sequence
  Synthetic oligonucleotide
gtccatgttggcgggc

SEQ ID NO: 80 - DNA, 16 bp, Artificial sequence
  Synthetic oligonucleotide
cgacttccttggccag

SEQ ID NO: 81 - DNA, 16 bp, Artificial sequence
  Synthetic oligonucleotide
atcgacttccttggcc

SEQ ID NO: 82 - DNA, 16 bp, Artificial sequence
  Synthetic oligonucleotide
tggtccgtaggccttg

SEQ ID NO: 83 - DNA, 16 bp, Artificial sequence
  Synthetic oligonucleotide
gatggtccgtaggcct

SEQ ID NO: 84 - DNA, 16 bp, Artificial sequence
  Synthetic oligonucleotide
tcaacgggagcaactt

SEQ ID NO: 85 - DNA, 16 bp, Artificial sequence
  Synthetic oligonucleotide
gcctcttctcaacggg

SEQ ID NO: 86 - DNA, 16 bp, Artificial sequence
  Synthetic oligonucleotide
tagcctcttctcaacg

SEQ ID NO: 87 - DNA, 16 bp, Artificial sequence
  Synthetic oligonucleotide
gcacggatgtccttct

SEQ ID NO: 88 - DNA, 16 bp, Artificial sequence
  Synthetic oligonucleotide
gctgcacggatgtcct

SEQ ID NO: 89 - DNA, 16 bp, Artificial sequence
  Synthetic oligonucleotide
ccagtgctgcacggat

SEQ ID NO: 90 - DNA, 16 bp, Artificial sequence
  Synthetic oligonucleotide
gtgccggtaggccggg

SEQ ID NO: 91 - DNA, 16 bp, Artificial sequence
  Synthetic oligonucleotide
atgtgccggtaggccg

SEQ ID NO: 92 - DNA, 16 bp, Artificial sequence
  Synthetic oligonucleotide
gccatgtgccggtagg

SEQ ID NO: 93 - DNA, 16 bp, Artificial sequence
  Synthetic oligonucleotide
cggccatgtgccggta

SEQ ID NO: 94 - DNA, 16 bp, Artificial sequence
  Synthetic oligonucleotide
cgtcttctgcagatgt

SEQ ID NO: 95 - DNA, 16 bp, Artificial sequence
  Synthetic oligonucleotide
gccggcagcgactccc

SEQ ID NO: 96 - DNA, 16 bp, Artificial sequence
  Synthetic oligonucleotide
agggccggcagcgact

SEQ ID NO: 97 - DNA, 16 bp, Artificial sequence
  Synthetic oligonucleotide
cgtagggccggcagcg

SEQ ID NO: 98 - DNA, 16 bp, Artificial sequence
  Synthetic oligonucleotide
tctgtagtttgctacg

SEQ ID NO: 99 - DNA, 16 bp, Artificial sequence
  Synthetic oligonucleotide
gctctgtagtttgcta

SEQ ID NO: 100 - DNA, 16 bp, Artificial sequence
  Synthetic oligonucleotide
gtcgggccgaaagttc

SEQ ID NO: 101 - DNA, 16 bp, Artificial sequence
  Synthetic oligonucleotide
ctttggttttgcgggt

SEQ ID NO: 102 - DNA, 16 bp, Artificial sequence
  Synthetic oligonucleotide
gagtgtccacctgatc

SEQ ID NO: 103 - DNA, 16 bp, Artificial sequence
  Synthetic oligonucleotide
cccggagagctccaga

SEQ ID NO: 104 - DNA, 16 bp, Artificial sequence
  Synthetic oligonucleotide
gcccccggagagctcc

SEQ ID NO: 105 - DNA, 16 bp, Artificial sequence
  Synthetic oligonucleotide
gcgcccccggagagct

SEQ ID NO: 106 - DNA, 16 bp, Artificial sequence
  Synthetic oligonucleotide
gcgattgattcgggcg

SEQ ID NO: 107 - DNA, 16 bp, Artificial sequence
  Synthetic oligonucleotide
agatgcgattgattcg

SEQ ID NO: 108 - DNA, 16 bp, Artificial sequence
  Synthetic oligonucleotide
gactccatggatgttc

SEQ ID NO: 109 - DNA, 16 bp, Artificial sequence
  Synthetic oligonucleotide
gcccggtcctgactcc

SEQ ID NO: 110 - DNA, 16 bp, Artificial sequence
  Synthetic oligonucleotide
aagcccggtcctgact

SEQ ID NO: 111 - DNA, 16 bp, Artificial sequence
  Synthetic oligonucleotide
gaaaagcccggtcctg

SEQ ID NO: 112 - DNA, 16 bp, Artificial sequence
  Synthetic oligonucleotide
ggtgaaaagcccggtc

SEQ ID NO: 113 - DNA, 16 bp, Artificial sequence
  Synthetic oligonucleotide
gaatgccaagtccggg

SEQ ID NO: 114 - DNA, 16 bp, Artificial sequence
  Synthetic oligonucleotide
ctcgaatgccaagtcc

SEQ ID NO: 115 - DNA, 16 bp, Artificial sequence
  Synthetic oligonucleotide
ggcctcgaatgccaag

SEQ ID NO: 116 - DNA, 16 bp, Artificial sequence
  Synthetic oligonucleotide
gacgacctgctttttc

SEQ ID NO: 117 - DNA, 16 bp, Artificial sequence
  Synthetic oligonucleotide
cttgacgacctgcttt

SEQ ID NO: 118 - DNA, 16 bp, Artificial sequence
  Synthetic oligonucleotide
gcttgacgacctgctt

SEQ ID NO: 119 - DNA, 16 bp, Artificial sequence
  Synthetic oligonucleotide
cagcttgacgacctgc

SEQ ID NO: 120 - DNA, 16 bp, Artificial sequence
  Synthetic oligonucleotide
ttcagcttgacgacct

SEQ ID NO: 121 - DNA, 16 bp, Artificial sequence
  Synthetic oligonucleotide
ctttcagcttgacgac

SEQ ID NO: 122 - DNA, 16 bp, Artificial sequence
  Synthetic oligonucleotide
ctctttcagcttgacg

SEQ ID NO: 123 - DNA, 16 bp, Artificial sequence
  Synthetic oligonucleotide
ggtcgacacatttcag

SEQ ID NO: 124 - DNA, 16 bp, Artificial sequence
  Synthetic oligonucleotide
caggtcgacacatttc

SEQ ID NO: 125 - DNA, 16 bp, Artificial sequence
  Synthetic oligonucleotide
tggataaccaggtcga

SEQ ID NO: 126 - DNA, 16 bp, Artificial sequence
  Synthetic oligonucleotide
attgattagctcctgg

SEQ ID NO: 127 - DNA, 16 bp, Artificial sequence
  Synthetic oligonucleotide
gcctaactgtattgat

SEQ ID NO: 128 - DNA, 16 bp, Artificial sequence
  Synthetic oligonucleotide
ctgcctaactgtattg

SEQ ID NO: 129 - DNA, 16 bp, Artificial sequence
  Synthetic oligonucleotide
acactgcctaactgta

SEQ ID NO: 130 - DNA, 16 bp, Artificial sequence
  Synthetic oligonucleotide
tactggtacactgcct

SEQ ID NO: 131 - DNA, 16 bp, Artificial sequence
  Synthetic oligonucleotide
ctgagcttactggtac

SEQ ID NO: 132 - DNA, 16 bp, Artificial sequence
  Synthetic oligonucleotide
gaactgagcttactgg

SEQ ID NO: 133 - DNA, 16 bp, Artificial sequence
  Synthetic oligonucleotide
ggtaggaactgagctt

SEQ ID NO: 134 - DNA, 16 bp, Artificial sequence
  Synthetic oligonucleotide
tcctctcgcaaccggg

SEQ ID NO: 135 - DNA, 16 bp, Artificial sequence
  Synthetic oligonucleotide
gtctcctctcgcaacc

SEQ ID NO: 136 - DNA, 16 bp, Artificial sequence
  Synthetic oligonucleotide
tctgtctcctctcgca

SEQ ID NO: 137 - DNA, 16 bp, Artificial sequence
  Synthetic oligonucleotide
gtgacgattcgctctg

SEQ ID NO: 138 - DNA, 16 bp, Artificial sequence
  Synthetic oligonucleotide
aagtggtgacgattcg

SEQ ID NO: 139 - DNA, 16 bp, Artificial sequence
  Synthetic oligonucleotide
gtaagtggtgacgatt

SEQ ID NO: 140 - DNA, 16 bp, Artificial sequence
  Synthetic oligonucleotide
ccgttcccggatgtaa

SEQ ID NO: 141 - DNA, 16 bp, Artificial sequence
  Synthetic oligonucleotide
cgttctcccctcccgt

SEQ ID NO: 142 - DNA, 16 bp, Artificial sequence
  Synthetic oligonucleotide
cagaagaatctggtcc

SEQ ID NO: 143 - DNA, 16 bp, Artificial sequence
  Synthetic oligonucleotide
gtcgatcagcagaaga

SEQ ID NO: 144 - DNA, 16 bp, Artificial sequence
  Synthetic oligonucleotide
caatgtcgatcagcag

SEQ ID NO: 145 - DNA, 16 bp, Artificial sequence
  Synthetic oligonucleotide
ctcaatgtcgatcagc

SEQ ID NO: 146 - DNA, 16 bp, Artificial sequence
  Synthetic oligonucleotide
ctgctcaatgtcgatc

SEQ ID NO: 147 - DNA, 16 bp, Artificial sequence
  Synthetic oligonucleotide
ggactgctcaatgtcg

SEQ ID NO: 148 - DNA, 16 bp, Artificial sequence
  Synthetic oligonucleotide
taggactgctcaatgt

SEQ ID NO: 149 - DNA, 16 bp, Artificial sequence
  Synthetic oligonucleotide
gatgtaggactgctca

SEQ ID NO: 150 - DNA, 16 bp, Artificial sequence
  Synthetic oligonucleotide
gttgatgtaggactgc

SEQ ID NO: 151 - DNA, 16 bp, Artificial sequence
  Synthetic oligonucleotide
ggctgatgttgttgat

SEQ ID NO: 152 - DNA, 16 bp, Artificial sequence
  Synthetic oligonucleotide
caggctgatgttgttg

SEQ ID NO: 153 - DNA, 16 bp, Artificial sequence
  Synthetic oligonucleotide
tcatcaggctgatgtt

SEQ ID NO: 154 - DNA, 16 bp, Artificial sequence
  Synthetic oligonucleotide
gcctttcatcaggctg

SEQ ID NO: 155 - DNA, 16 bp, Artificial sequence
  Synthetic oligonucleotide
tgactcggcagtcagc

SEQ ID NO: 156 - DNA, 16 bp, Artificial sequence
  Synthetic oligonucleotide
cagtgactcggcagtc

SEQ ID NO: 157 - DNA, 16 bp, Artificial sequence
  Synthetic oligonucleotide
aggacagtgactcggc

SEQ ID NO: 158 - DNA, 16 bp, Artificial sequence
  Synthetic oligonucleotide
atcacggatcttgagg

SEQ ID NO: 159 - DNA, 16 bp, Artificial sequence
  Synthetic oligonucleotide
ccacatcacggatctt

SEQ ID NO: 160 - DNA, 16 bp, Artificial sequence
  Synthetic oligonucleotide
tccacatcacggatct

SEQ ID NO: 161 - DNA, 16 bp, Artificial sequence
  Synthetic oligonucleotide
tctccacatcacggat

SEQ ID NO: 162 - DNA, 16 bp, Artificial sequence
  Synthetic oligonucleotide
gaagatggcgaagacg

SEQ ID NO: 163 - DNA, 16 bp, Artificial sequence
  Synthetic oligonucleotide
caggtccttgtagacg

SEQ ID NO: 164 - DNA, 16 bp, Artificial sequence
  Synthetic oligonucleotide
gctcgatctgccgcag

SEQ ID NO: 165 - DNA, 16 bp, Artificial sequence
  Synthetic oligonucleotide
cagctcgatctgccgc

SEQ ID NO: 166 - DNA, 16 bp, Artificial sequence
  Synthetic oligonucleotide
tcggaggaacgaggcc

SEQ ID NO: 167 - DNA, 16 bp, Artificial sequence
  Synthetic oligonucleotide
gctcggaggaacgagg

SEQ ID NO: 168 - DNA, 16 bp, Artificial sequence
  Synthetic oligonucleotide
cagctcggaggaacga

SEQ ID NO: 169 - DNA, 16 bp, Artificial sequence
  Synthetic oligonucleotide
gccagctcggaggaac

SEQ ID NO: 170 - DNA, 16 bp, Artificial sequence
  Synthetic oligonucleotide
gcctggtccttctcgg

SEQ ID NO: 171 - DNA, 16 bp, Artificial sequence
  Synthetic oligonucleotide
aggtgttctcctgggc

SEQ ID NO: 172 - DNA, 16 bp, Artificial sequence
  Synthetic oligonucleotide
gaaggtgttctcctgg

SEQ ID NO: 173 - DNA, 16 bp, Artificial sequence
  Synthetic oligonucleotide
ggagaaggtgttctcc

SEQ ID NO: 174 - DNA, 16 bp, Artificial sequence
  Synthetic oligonucleotide
atggacttgttgatga

SEQ ID NO: 175 - DNA, 16 bp, Artificial sequence
  Synthetic oligonucleotide
tcgcggatggacttgt

SEQ ID NO: 176 - DNA, 16 bp, Artificial sequence
  Synthetic oligonucleotide
ggtcgcggatggactt

SEQ ID NO: 177 - DNA, 16 bp, Artificial sequence
  Synthetic oligonucleotide
tgaggtcgcggatgga

SEQ ID NO: 178 - DNA, 16 bp, Artificial sequence
  Synthetic oligonucleotide
cgtggtggatgaaggc

SEQ ID NO: 179 - DNA, 16 bp, Artificial sequence
  Synthetic oligonucleotide
ccgaggagtataggta

SEQ ID NO: 180 - DNA, 16 bp, Artificial sequence
  Synthetic oligonucleotide
ctgccgaggagtatag

SEQ ID NO: 181 - DNA, 16 bp, Artificial sequence
  Synthetic oligonucleotide
gtctgccgaggagtat

SEQ ID NO: 182 - DNA, 16 bp, Artificial sequence
  Synthetic oligonucleotide
ctggtctgccgaggag

SEQ ID NO: 183 - DNA, 16 bp, Artificial sequence
  Synthetic oligonucleotide
gctctggtctgccgag

SEQ ID NO: 184 - DNA, 16 bp, Artificial sequence
  Synthetic oligonucleotide
ctggacaccggtcggc

SEQ ID NO: 185 - DNA, 16 bp, Artificial sequence
  Synthetic oligonucleotide
atgctggacaccggtc

SEQ ID NO: 186 - DNA, 16 bp, Artificial sequence
  Synthetic oligonucleotide
gtatgctggacaccgg

SEQ ID NO: 187 - DNA, 16 bp, Artificial sequence
  Synthetic oligonucleotide
gggtgtatgctggaca

SEQ ID NO: 188 - DNA, 16 bp, Artificial sequence
  Synthetic oligonucleotide
cacgggaacaggaatc

SEQ ID NO: 189 - DNA, 16 bp, Artificial sequence
  Synthetic oligonucleotide
ctgcccccacgggaac

SEQ ID NO: 190 - DNA, 16 bp, Artificial sequence
  Synthetic oligonucleotide
cgccgagaaggaggct

SEQ ID NO: 191 - DNA, 16 bp, Artificial sequence
  Synthetic oligonucleotide
gttggcaaacacgctc

SEQ ID NO: 192 - DNA, 16 bp, Artificial sequence
  Synthetic oligonucleotide
ctgttggcaaacacgc

SEQ ID NO: 193 - DNA, 16 bp, Artificial sequence
  Synthetic oligonucleotide
gaggtcactgttggca

SEQ ID NO: 194 - DNA, 16 bp, Artificial sequence
  Synthetic oligonucleotide
ggccgagatgggatct

SEQ ID NO: 195 - DNA, 16 bp, Artificial sequence
  Synthetic oligonucleotide
ctggccgagatgggat

SEQ ID NO: 196 - DNA, 16 bp, Artificial sequence
  Synthetic oligonucleotide
gaactggccgagatgg

SEQ ID NO: 197 - DNA, 16 bp, Artificial sequence
  Synthetic oligonucleotide
tccgaactggccgaga

SEQ ID NO: 198 - DNA, 16 bp, Artificial sequence
  Synthetic oligonucleotide
gggatccgaactggcc

SEQ ID NO: 199 - DNA, 16 bp, Artificial sequence
  Synthetic oligonucleotide
gctgggcggataatgg

SEQ ID NO: 200 - DNA, 16 bp, Artificial sequence
  Synthetic oligonucleotide
gctcggctgggcggat

SEQ ID NO: 201 - DNA, 16 bp, Artificial sequence
  Synthetic oligonucleotide
tggctcggctgggcgg

SEQ ID NO: 202 - DNA, 16 bp, Artificial sequence
  Synthetic oligonucleotide
agggatggctcggctg

SEQ ID NO: 203 - DNA, 16 bp, Artificial sequence
  Synthetic oligonucleotide
agtcgagcagggatgg

SEQ ID NO: 204 - DNA, 16 bp, Artificial sequence
  Synthetic oligonucleotide
ggcctagtcgagcagg

SEQ ID NO: 205 - DNA, 16 bp, Artificial sequence
  Synthetic oligonucleotide
cgaggcctagtcgagc

SEQ ID NO: 206 - DNA, 16 bp, Artificial sequence
  Synthetic oligonucleotide
ccctcgaggcctagtc

SEQ ID NO: 207 - DNA, 16 bp, Artificial sequence
  Synthetic oligonucleotide
cccccctcgaggccta

SEQ ID NO: 208 - DNA, 16 bp, Artificial sequence
  Synthetic oligonucleotide
cgcccccctcgaggcc

SEQ ID NO: 209 - DNA, 16 bp, Artificial sequence
  Synthetic oligonucleotide
cccgagagcacgcccc

SEQ ID NO: 210 - DNA, 16 bp, Artificial sequence
  Synthetic oligonucleotide
ccccccgagagcacgc

SEQ ID NO: 211 - DNA, 16 bp, Artificial sequence
  Synthetic oligonucleotide
ggcccccccgagagca

SEQ ID NO: 212 - DNA, 16 bp, Artificial sequence
  Synthetic oligonucleotide
cgtgaggcccccccga

SEQ ID NO: 213 - DNA, 16 bp, Artificial sequence
  Synthetic oligonucleotide
aagctcctgcgccgcg

SEQ ID NO: 214 - DNA, 16 bp, Artificial sequence
  Synthetic oligonucleotide
gaccactgaagctcct

SEQ ID NO: 215 - DNA, 16 bp, Artificial sequence
  Synthetic oligonucleotide
cagaccactgaagctc

SEQ ID NO: 216 - DNA, 16 bp, Artificial sequence
  Synthetic oligonucleotide
cggagggccccagacc

SEQ ID NO: 217 - DNA, 16 bp, Artificial sequence
  Synthetic oligonucleotide
ggcggagggccccaga

SEQ ID NO: 218 - DNA, 16 bp, Artificial sequence
  Synthetic oligonucleotide
tggtcccagcataggg

SEQ ID NO: 219 - DNA, 16 bp, Artificial sequence
  Synthetic oligonucleotide
cctggtcccagcatag

SEQ ID NO: 220 - DNA, 16 bp, Artificial sequence
  Synthetic oligonucleotide
actgggagcctggtcc

SEQ ID NO: 221 - DNA, 16 bp, Artificial sequence
  Synthetic oligonucleotide
cgttaaggaagaggcc

SEQ ID NO: 222 - DNA, 16 bp, Artificial sequence
  Synthetic oligonucleotide
gcggtgtccagccagg

SEQ ID NO: 223 - DNA, 16 bp, Artificial sequence
  Synthetic oligonucleotide
gtgcggtgtccagcca

SEQ ID NO: 224 - DNA, 16 bp, Artificial sequence
  Synthetic oligonucleotide
cgcagtgcggtgtcca

SEQ ID NO: 225 - DNA, 16 bp, Artificial sequence
  Synthetic oligonucleotide
ttgcgcagtgcggtgt

SEQ ID NO: 226 - DNA, 16 bp, Artificial sequence
  Synthetic oligonucleotide
ctttgcgcagtgcggt

SEQ ID NO: 227 - DNA, 16 bp, Artificial sequence
  Synthetic oligonucleotide
cccctttgcgcagtgc

SEQ ID NO: 228 - DNA, 16 bp, Artificial sequence
  Synthetic oligonucleotide
gggcccctttgcgcag

SEQ ID NO: 229 - DNA, 16 bp, Artificial sequence
  Synthetic oligonucleotide
cagggcccctttgcgc

SEQ ID NO: 230 - DNA, 16 bp, Artificial sequence
  Synthetic oligonucleotide
tgcaacaccccagcgc

SEQ ID NO: 231 - DNA, 16 bp, Artificial sequence
  Synthetic oligonucleotide
caaagtgcaacacccc

SEQ ID NO: 232 - DNA, 16 bp, Artificial sequence
  Synthetic oligonucleotide
ccccaaagtgcaacac

SEQ ID NO: 233 - DNA, 16 bp, Artificial sequence
  Synthetic oligonucleotide
tggtcccccctctgcc

SEQ ID NO: 234 - DNA, 16 bp, Artificial sequence
  Synthetic oligonucleotide
caagggttctggtccc

SEQ ID NO: 235 - DNA, 16 bp, Artificial sequence
  Synthetic oligonucleotide
tgtcaagggttctggt

SEQ ID NO: 236 - DNA, 16 bp, Artificial sequence
  Synthetic oligonucleotide
ggtgtcaagggttctg

SEQ ID NO: 237 - DNA, 16 bp, Artificial sequence
  Synthetic oligonucleotide
ggatggtgtcaagggt

SEQ ID NO: 238 - DNA, 16 bp, Artificial sequence
  Synthetic oligonucleotide
gacccctcattcagga

SEQ ID NO: 239 - DNA, 16 bp, Artificial sequence
  Synthetic oligonucleotide
tggacccctcattcag

SEQ ID NO: 240 - DNA, 16 bp, Artificial sequence
  Synthetic oligonucleotide
ggctggacccctcatt

SEQ ID NO: 241 - DNA, 16 bp, Artificial sequence
  Synthetic oligonucleotide
gagtcccccccaggct

SEQ ID NO: 242 - DNA, 16 bp, Artificial sequence
  Synthetic oligonucleotide
ggtagagtccccccca

SEQ ID NO: 243 - DNA, 16 bp, Artificial sequence
  Synthetic oligonucleotide
ccttggtagagtcccc

SEQ ID NO: 244 - DNA, 16 bp, Artificial sequence
  Synthetic oligonucleotide
agaccttggtagagtc

SEQ ID NO: 245 - DNA, 16 bp, Artificial sequence
  Synthetic oligonucleotide
cctacatgggctttcc

SEQ ID NO: 246 - DNA, 16 bp, Artificial sequence
  Synthetic oligonucleotide
ctgccctacatgggct

SEQ ID NO: 247 - DNA, 16 bp, Artificial sequence
  Synthetic oligonucleotide
atagaaggcctgccct

SEQ ID NO: 248 - DNA, 16 bp, Artificial sequence
  Synthetic oligonucleotide
ttatagaaggcctgcc

SEQ ID NO: 249 - DNA, 16 bp, Artificial sequence
  Synthetic oligonucleotide
gcacttatagaaggcc

SEQ ID NO: 250 - DNA, 16 bp, Artificial sequence
  Synthetic oligonucleotide
gcccgcacttatagaa

SEQ ID NO: 251 - DNA, 16 bp, Artificial sequence
  Synthetic oligonucleotide
gtgcccgcacttatag

SEQ ID NO: 252 - DNA, 16 bp, Artificial sequence
  Synthetic oligonucleotide
cgcccttggtgcccgc

SEQ ID NO: 253 - DNA, 16 bp, Artificial sequence
  Synthetic oligonucleotide
tatacccctgcacccc

SEQ ID NO: 254 - DNA, 16 bp, Artificial sequence
  Synthetic oligonucleotide
ggaagttgatataccc

SEQ ID NO: 255 - DNA, 16 bp, Artificial sequence
  Synthetic oligonucleotide
gctaatgggaagttga

SEQ ID NO: 256 - DNA, 16 bp, Artificial sequence
  Synthetic oligonucleotide
cctgctaatgggaagt

SEQ ID NO: 257 - DNA, 16 bp, Artificial sequence
  Synthetic oligonucleotide
gctcctgctaatggga

SEQ ID NO: 258 - DNA, 16 bp, Artificial sequence
  Synthetic oligonucleotide
gggagctcctgctaat

SEQ ID NO: 259 - DNA, 16 bp, Artificial sequence
  Synthetic oligonucleotide
gccaggcttgccgctg

SEQ ID NO: 260 - DNA, 16 bp, Artificial sequence
  Synthetic oligonucleotide
gggccaggcttgccgc

SEQ ID NO: 261 - DNA, 16 bp, Artificial sequence
  Synthetic oligonucleotide
accgagcccactgggc

SEQ ID NO: 262 - DNA, 16 bp, Artificial sequence
  Synthetic oligonucleotide
ctaccgagcccactgg

SEQ ID NO: 263 - DNA, 16 bp, Artificial sequence
  Synthetic oligonucleotide
gggcactaccgagccc

SEQ ID NO: 264 - DNA, 16 bp, Artificial sequence
  Synthetic oligonucleotide
cagctgggcactaccg

SEQ ID NO: 265 - DNA, 16 bp, Artificial sequence
  Synthetic oligonucleotide
tgtacacctcaggcct

SEQ ID NO: 266 - DNA, 16 bp, Artificial sequence
  Synthetic oligonucleotide
ctatgtacacctcagg

SEQ ID NO: 267 - DNA, 16 bp, Artificial sequence
  Synthetic oligonucleotide
ggactatgtacacctc

SEQ ID NO: 268 - DNA, 16 bp, Artificial sequence
  Synthetic oligonucleotide
gaaggactatgtacac

SEQ ID NO: 269 - DNA, 16 bp, Artificial sequence
  Synthetic oligonucleotide
ggccgggaaggactat

SEQ ID NO: 270 - DNA, 16 bp, Artificial sequence
  Synthetic oligonucleotide
atggccgggaaggact

SEQ ID NO: 271 - DNA, 16 bp, Artificial sequence
  Synthetic oligonucleotide
aatatggccgggaagg

SEQ ID NO: 272 - DNA, 16 bp, Artificial sequence
  Synthetic oligonucleotide
ggttaatatggccggg

SEQ ID NO: 273 - DNA, 16 bp, Artificial sequence
  Synthetic oligonucleotide
ggctgtgtggttaata

SEQ ID NO: 274 - DNA, 16 bp, Artificial sequence
  Synthetic oligonucleotide
cctctggcagccgagg

SEQ ID NO: 275 - DNA, 16 bp, Artificial sequence
  Synthetic oligonucleotide
gcacctctggcagccg

SEQ ID NO: 276 - DNA, 16 bp, Artificial sequence
  Synthetic oligonucleotide
aggcacctctggcagc

SEQ ID NO: 277 - DNA, 16 bp, Artificial sequence
  Synthetic oligonucleotide
tagcaaaggcacctct

SEQ ID NO: 278 - DNA, 16 bp, Artificial sequence
  Synthetic oligonucleotide
gcctagcaaaggcacc

SEQ ID NO: 279 - DNA, 16 bp, Artificial sequence
  Synthetic oligonucleotide
ccgggcctagcaaagg

SEQ ID NO: 280 - DNA, 16 bp, Artificial sequence
  Synthetic oligonucleotide
gctccgggcctagcaa

SEQ ID NO: 281 - DNA, 16 bp, Artificial sequence
  Synthetic oligonucleotide
cggctccgggcctagc

SEQ ID NO: 282 - DNA, 16 bp, Artificial sequence
  Synthetic oligonucleotide
ccaacggctccgggcc

SEQ ID NO: 283 - DNA, 16 bp, Artificial sequence
  Synthetic oligonucleotide
ggcccgggccaacggc

SEQ ID NO: 284 - DNA, 16 bp, Artificial sequence
  Synthetic oligonucleotide
ccggcccgggccaacg

SEQ ID NO: 285 - DNA, 16 bp, Artificial sequence
  Synthetic oligonucleotide
ggccggcccgggccaa

SEQ ID NO: 286 - DNA, 16 bp, Artificial sequence
  Synthetic oligonucleotide
aaggccggcccgggcc

SEQ ID NO: 287 - DNA, 16 bp, Artificial sequence
  Synthetic oligonucleotide
gcaaggccggcccggg

SEQ ID NO: 288 - DNA, 16 bp, Artificial sequence
  Synthetic oligonucleotide
gggcaaggccggcccg

SEQ ID NO: 289 - DNA, 16 bp, Artificial sequence
  Synthetic oligonucleotide
tagggcaaggccggcc

SEQ ID NO: 290 - DNA, 16 bp, Artificial sequence
  Synthetic oligonucleotide
aggaatagggcaaggc

SEQ ID NO: 291 - DNA, 16 bp, Artificial sequence
  Synthetic oligonucleotide
accacccacatagccc

SEQ ID NO: 292 - DNA, 16 bp, Artificial sequence
  Synthetic oligonucleotide
caagaccccccgccac

SEQ ID NO: 293 - DNA, 16 bp, Artificial sequence
  Synthetic oligonucleotide
ccccaagaccccccgc

SEQ ID NO: 294 - DNA, 16 bp, Artificial sequence
  Synthetic oligonucleotide
agaggcccccaagacc

SEQ ID NO: 295 - DNA, 16 bp, Artificial sequence
  Synthetic oligonucleotide
ggcccacccatcaggg

SEQ ID NO: 296 - DNA, 16 bp, Artificial sequence
  Synthetic oligonucleotide
tgggcccacccatcag

SEQ ID NO: 297 - DNA, 16 bp, Artificial sequence
  Synthetic oligonucleotide
agagagaggccgccct

SEQ ID NO: 298 - DNA, 16 bp, Artificial sequence
  Synthetic oligonucleotide
tcagagagaggccgcc

SEQ ID NO: 299 - DNA, 16 bp, Artificial sequence
  Synthetic oligonucleotide
gagtgggtgaggtctc

SEQ ID NO: 300 - DNA, 16 bp, Artificial sequence
  Synthetic oligonucleotide
gagcgaggagtgggtg

SEQ ID NO: 301 - DNA, 16 bp, Artificial sequence
  Synthetic oligonucleotide
aactgagcgaggagtg

SEQ ID NO: 302 - DNA, 16 bp, Artificial sequence
  Synthetic oligonucleotide
tcaaactgagcgagga

SEQ ID NO: 303 - DNA, 16 bp, Artificial sequence
  Synthetic oligonucleotide
gtggtcaaactgagcg

SEQ ID NO: 304 - DNA, 16 bp, Artificial sequence
  Synthetic oligonucleotide
cttacagtggtcaaac

SEQ ID NO: 305 - DNA, 16 bp, Artificial sequence
  Synthetic oligonucleotide
gagtgcaggcacttac

SEQ ID NO: 306 - DNA, 16 bp, Artificial sequence
  Synthetic oligonucleotide
aatacagagtgcaggc

SEQ ID NO: 307 - DNA, 16 bp, Artificial sequence
  Synthetic oligonucleotide
ccacgagatcaacaca

SEQ ID NO: 308 - DNA, 16 bp, Artificial sequence
  Synthetic oligonucleotide
gaccacgagatcaaca

SEQ ID NO: 309 - DNA, 16 bp, Artificial sequence
  Synthetic oligonucleotide
agaccacgagatcaac

SEQ ID NO: 310 - DNA, 16 bp, Artificial sequence
  Synthetic oligonucleotide
ctgagaccacgagatc

SEQ ID NO: 311 - DNA, 16 bp, Artificial sequence
  Synthetic oligonucleotide
gctctgagaccacgag

SEQ ID NO: 312 - DNA, 16 bp, Artificial sequence
  Synthetic oligonucleotide
gaccgtggccagctct

SEQ ID NO: 313 - DNA, 16 bp, Artificial sequence
  Synthetic oligonucleotide
atgaccgtggccagct

SEQ ID NO: 314 - DNA, 16 bp, Artificial sequence
  Synthetic oligonucleotide
tatgaccgtggccagc

SEQ ID NO: 315 - DNA, 16 bp, Artificial sequence
  Synthetic oligonucleotide
tttatgaccgtggcca

SEQ ID NO: 316 - DNA, 16 bp, Artificial sequence
  Synthetic oligonucleotide
ttttatgaccgtggcc

SEQ ID NO: 317 - DNA, 16 bp, Artificial sequence
  Synthetic oligonucleotide
cggcacacttttttat

SEQ ID NO: 318 - DNA, 16 bp, Artificial sequence
  Synthetic oligonucleotide
ttctcggcacactttt

SEQ ID NO: 319 - DNA, 16 bp, Artificial sequence
  Synthetic oligonucleotide
ccccgccgcgggcacg

SEQ ID NO: 320 - DNA, 16 bp, Artificial sequence
  Synthetic oligonucleotide
ccaaaggagggccccc

SEQ ID NO: 321 - DNA, 16 bp, Artificial sequence
  Synthetic oligonucleotide
cgccagcctagtggcc

SEQ ID NO: 322 - DNA, 16 bp, Artificial sequence
  Synthetic oligonucleotide
tgggactaccacccta

SEQ ID NO: 323 - DNA, 16 bp, Artificial sequence
  Synthetic oligonucleotide
ctccatactggccggc

SEQ ID NO: 324 - DNA, 16 bp, Artificial sequence
  Synthetic oligonucleotide
cttaacgaggccagcc

SEQ ID NO: 325 - DNA, 16 bp, Artificial sequence
  Synthetic oligonucleotide
acccatctaggcccca

SEQ ID NO: 326 - DNA, 16 bp, Artificial sequence
  Synthetic oligonucleotide
tggtgcaccgcagaca

SEQ ID NO: 327 - DNA, 16 bp, Artificial sequence
  Synthetic oligonucleotide
tcaggaggcgagattg

SEQ ID NO: 328 - DNA, 16 bp, Artificial sequence
  Synthetic oligonucleotide
cgggaaaaccccgcct

SEQ ID NO: 329 - DNA, 16 bp, Artificial sequence
  Synthetic oligonucleotide
agccactaagtggccc

SEQ ID NO: 330 - DNA, 16 bp, Artificial sequence
  Synthetic oligonucleotide
gctaaactggcctccg

SEQ ID NO: 331 - DNA, 16 bp, Artificial sequence
  Synthetic oligonucleotide
gccaacgggcatccga

SEQ ID NO: 332 - DNA, 16 bp, Artificial sequence
  Synthetic oligonucleotide
gtccactcccagtagg

SEQ ID NO: 333 - DNA, 16 bp, Artificial sequence
  Synthetic oligonucleotide
ggtgatccgatgctgg

SEQ ID NO: 334 - DNA, 16 bp, Artificial sequence
  Synthetic oligonucleotide
ggccatcttccgccct

SEQ ID NO: 335 - DNA, 16 bp, Artificial sequence
  Synthetic oligonucleotide
ctaacctaggccgggt

SEQ ID NO: 336 - DNA, 16 bp, Artificial sequence
  Synthetic oligonucleotide
agacgcagggccacat

SEQ ID NO: 337 - DNA, 16 bp, Artificial sequence
  Synthetic oligonucleotide
ggctctagagggccca

SEQ ID NO: 338 - DNA, 16 bp, Artificial sequence
  Synthetic oligonucleotide
ccgcatacagcctttt

SEQ ID NO: 339 - DNA, 16 bp, Artificial sequence
  Synthetic oligonucleotide
gcattccacgggcagc

SEQ ID NO: 340 - DNA, 16 bp, Artificial sequence
  Synthetic oligonucleotide
caccgctaccctagct

SEQ ID NO: 341 - DNA, 16 bp, Artificial sequence
  Synthetic oligonucleotide
gggcaccccgcaggtt

SEQ ID NO: 342 - DNA, 16 bp, Artificial sequence
  Synthetic oligonucleotide
tctagaaggaccctgt

SEQ ID NO: 343 - DNA, 16 bp, Artificial sequence
  Synthetic oligonucleotide
agccgggcttccgtct

SEQ ID NO: 344 - DNA, 16 bp, Artificial sequence
  Synthetic oligonucleotide
tttaagggcgcggtgg

SEQ ID NO: 345 - DNA, 16 bp, Artificial sequence
  Synthetic oligonucleotide
tgcacttccggacagg

SEQ ID NO: 346 - DNA, 16 bp, Artificial sequence
  Synthetic oligonucleotide
caccagcccaggcgcg

SEQ ID NO: 347 - DNA, 16 bp, Artificial sequence
  Synthetic oligonucleotide
agctaggttaatttct

SEQ ID NO: 348 - DNA, 16 bp, Artificial sequence
  Synthetic oligonucleotide
caacatcccgccaggc

SEQ ID NO: 349 - DNA, 16 bp, Artificial sequence
  Synthetic oligonucleotide
agcaatctagcctccc

SEQ ID NO: 350 - DNA, 16 bp, Artificial sequence
  Synthetic oligonucleotide
tgcaatgtccagtcct

SEQ ID NO: 351 - DNA, 16 bp, Artificial sequence
  Synthetic oligonucleotide
acctagcaagcctacc

SEQ ID NO: 352 - DNA, 16 bp, Artificial sequence
  Synthetic oligonucleotide
gctacagcaatataga

SEQ ID NO: 353 - DNA, 16 bp, Artificial sequence
  Synthetic oligonucleotide
tcttaacaggctccct

SEQ ID NO: 354 - DNA, 16 bp, Artificial sequence
  Synthetic oligonucleotide
cctcagggacgacttc

SEQ ID NO: 355 - DNA, 16 bp, Artificial sequence
  Synthetic oligonucleotide
tatacgggcatgttga

SEQ ID NO: 356 - DNA, 16 bp, Artificial sequence
  Synthetic oligonucleotide
gtgcatcccgagaggg

SEQ ID NO: 357 - DNA, 16 bp, Artificial sequence
  Synthetic oligonucleotide
atgaaagtctccactt

SEQ ID NO: 358 - DNA, 16 bp, Artificial sequence
  Synthetic oligonucleotide
aaccgctgggatcccc

SEQ ID NO: 359 - DNA, 16 bp, Artificial sequence
  Synthetic oligonucleotide
gtacaggagttcccca

SEQ ID NO: 360 - DNA, 16 bp, Artificial sequence
  Synthetic oligonucleotide
aaatacaccctagatg

SEQ ID NO: 361 - DNA, 16 bp, Artificial sequence
  Synthetic oligonucleotide
gaagattttggccggg

SEQ ID NO: 362 - DNA, 16 bp, Artificial sequence
  Synthetic oligonucleotide
ctccaggacacaccgt

SEQ ID NO: 363 - DNA, 16 bp, Artificial sequence
  Synthetic oligonucleotide
gggagtaggctcgacc

SEQ ID NO: 364 - DNA, 16 bp, Artificial sequence
  Synthetic oligonucleotide
ccctattccacaggac

SEQ ID NO: 365 - DNA, 16 bp, Artificial sequence
  Synthetic oligonucleotide
gctaagagcagccctc

SEQ ID NO: 366 - DNA, 16 bp, Artificial sequence
  Synthetic oligonucleotide
ggcatcacggccgggc

SEQ ID NO: 367 - DNA, 16 bp, Artificial sequence
  Synthetic oligonucleotide
tgtcaccccagccgaa

SEQ ID NO: 368 - DNA, 16 bp, Artificial sequence
  Synthetic oligonucleotide
agccgggcaccaccca

SEQ ID NO: 369 - DNA, 16 bp, Artificial sequence
  Synthetic oligonucleotide
ggcaaggacagccgac

SEQ ID NO: 370 - DNA, 16 bp, Artificial sequence
  Synthetic oligonucleotide
gtttggcaaggacagc

SEQ ID NO: 371 - DNA, 16 bp, Artificial sequence
  Synthetic oligonucleotide
gtggtttggcaaggac

SEQ ID NO: 372 - DNA, 16 bp, Artificial sequence
  Synthetic oligonucleotide
gcagtggtttggcaag

SEQ ID NO: 373 - DNA, 16 bp, Artificial sequence
  Synthetic oligonucleotide
atgcagtggtttggca

SEQ ID NO: 374 - DNA, 16 bp, Artificial sequence
  Synthetic oligonucleotide
tcaacaccttgagggc

SEQ ID NO: 375 - DNA, 16 bp, Artificial sequence
  Synthetic oligonucleotide
tgcctaggcgatcctc

SEQ ID NO: 376 - DNA, 16 bp, Artificial sequence
  Synthetic oligonucleotide
gacattgctgtcgcag

SEQ ID NO: 377 - DNA, 16 bp, Artificial sequence
  Synthetic oligonucleotide
tcccaagtgcccccca

SEQ ID NO: 378 - DNA, 16 bp, Artificial sequence
  Synthetic oligonucleotide
agccggcacggttgct

SEQ ID NO: 379 - DNA, 16 bp, Artificial sequence
  Synthetic oligonucleotide
gagaacattcgcccca

SEQ ID NO: 380 - DNA, 16 bp, Artificial sequence
  Synthetic oligonucleotide
tgacctgtggcaattc

SEQ ID NO: 381 - DNA, 16 bp, Artificial sequence
  Synthetic oligonucleotide
ggtgacctgtggcaat

SEQ ID NO: 382 - DNA, 16 bp, Artificial sequence
  Synthetic oligonucleotide
tcccgtatcggcccct

SEQ ID NO: 383 - DNA, 16 bp, Artificial sequence
  Synthetic oligonucleotide
gtccagccgcgagtcc

SEQ ID NO: 384 - DNA, 16 bp, Artificial sequence
  Synthetic oligonucleotide
ggcagacccgcagtca

SEQ ID NO: 385 - DNA, 16 bp, Artificial sequence
  Synthetic oligonucleotide
gggcaagccacccctc

SEQ ID NO: 386 - DNA, 16 bp, Artificial sequence
  Synthetic oligonucleotide
aagtcgagctccgccc

SEQ ID NO: 387 - DNA, 16 bp, Artificial sequence
  Synthetic oligonucleotide
tggtcctagcccgtcc

SEQ ID NO: 388 - DNA, 16 bp, Artificial sequence
  Synthetic oligonucleotide
gggtacaggcaaacct

SEQ ID NO: 389 - DNA, 16 bp, Artificial sequence
  Synthetic oligonucleotide
ccatacccccatctga

SEQ ID NO: 390 - DNA, 16 bp, Artificial sequence
  Synthetic oligonucleotide
gcgcagagggcctcgc

SEQ ID NO: 391 - DNA, 16 bp, Artificial sequence
  Synthetic oligonucleotide
cactacagacatccct

SEQ ID NO: 392 - DNA, 16 bp, Artificial sequence
  Synthetic oligonucleotide
agccagggcccggctt

SEQ ID NO: 393 - DNA, 16 bp, Artificial sequence
  Synthetic oligonucleotide
ctccaactgtagggct

SEQ ID NO: 394 - DNA, 16 bp, Artificial sequence
  Synthetic oligonucleotide
gcggatggtggcattc

SEQ ID NO: 395 - DNA, 16 bp, Artificial sequence
  Synthetic oligonucleotide
cagcagcggcggtgac

SEQ ID NO: 396 - DNA, 16 bp, Artificial sequence
  Synthetic oligonucleotide
ctcttagcatggcccc

SEQ ID NO: 397 - DNA, 16 bp, Artificial sequence
  Synthetic oligonucleotide
ggcctgggatgctacc

SEQ ID NO: 398 - DNA, 16 bp, Artificial sequence
  Synthetic oligonucleotide
ttaaacccccctctgg

SEQ ID NO: 399 - DNA, 16 bp, Artificial sequence
  Synthetic oligonucleotide
gcccaagccctcggcg

SEQ ID NO: 400 - DNA, 16 bp, Artificial sequence
  Synthetic oligonucleotide
atgcacgcgctaccat

SEQ ID NO: 401 - DNA, 16 bp, Artificial sequence
  Synthetic oligonucleotide
acatatcctggccggg

SEQ ID NO: 402 - DNA, 16 bp, Artificial sequence
  Synthetic oligonucleotide
ctggatgtgggaacgg

SEQ ID NO: 403 - DNA, 16 bp, Artificial sequence
  Synthetic oligonucleotide
cctcaggccgccccat

SEQ ID NO: 404 - DNA, 16 bp, Artificial sequence
  Synthetic oligonucleotide
ggccatggagggtcac

SEQ ID NO: 405 - DNA, 16 bp, Artificial sequence
  Synthetic oligonucleotide
gggacaactggcgaca

SEQ ID NO: 406 - DNA, 16 bp, Artificial sequence
  Synthetic oligonucleotide
tggtagagggctggtg

SEQ ID NO: 407 - DNA, 16 bp, Artificial sequence
  Synthetic oligonucleotide
gcccatcggctgctgt

SEQ ID NO: 408 - DNA, 16 bp, Artificial sequence
  Synthetic oligonucleotide
gggtaggcctgcgctc

SEQ ID NO: 409 - DNA, 16 bp, Artificial sequence
  Synthetic oligonucleotide
tgccatgatcaggcgg

SEQ ID NO: 410 - DNA, 16 bp, Artificial sequence
  Synthetic oligonucleotide
accaagtgggcaccta

SEQ ID NO: 411 - DNA, 16 bp, Artificial sequence
  Synthetic oligonucleotide
ccacaaggccccgccg

SEQ ID NO: 412 - DNA, 16 bp, Artificial sequence
  Synthetic oligonucleotide
gtgaccaggtgcgggt

SEQ ID NO: 413 - DNA, 16 bp, Artificial sequence
  Synthetic oligonucleotide
ctgggcagagccgatc

SEQ ID NO: 414 - DNA, 16 bp, Artificial sequence
  Synthetic oligonucleotide
gacgaggctggccctg

SEQ ID NO: 415 - DNA, 16 bp, Artificial sequence
  Synthetic oligonucleotide
ccccactgtgctaaac

SEQ ID NO: 416 - DNA, 16 bp, Artificial sequence
  Synthetic oligonucleotide
agtcagccgtcctcgc

SEQ ID NO: 417 - DNA, 16 bp, Artificial sequence
  Synthetic oligonucleotide
caccaggccgagagca

SEQ ID NO: 418 - DNA, 16 bp, Artificial sequence
  Synthetic oligonucleotide
gcccaggcaccgacca

SEQ ID NO: 419 - DNA, 16 bp, Artificial sequence
  Synthetic oligonucleotide
ccccggaacctcaggc

SEQ ID NO: 420 - DNA, 16 bp, Artificial sequence
  Synthetic oligonucleotide
cagcacgctgtgtgca

SEQ ID NO: 421 - DNA, 16 bp, Artificial sequence
  Synthetic oligonucleotide
cactcggccgctcttc

SEQ ID NO: 422 - DNA, 16 bp, Artificial sequence
  Synthetic oligonucleotide
gcgcactgccctgtcg

SEQ ID NO: 423 - DNA, 16 bp, Artificial sequence
  Synthetic oligonucleotide
caagagggccccctac

SEQ ID NO: 424 - DNA, 16 bp, Artificial sequence
  Synthetic oligonucleotide
tatgaatccccctccc

SEQ ID NO: 425 - DNA, 16 bp, Artificial sequence
  Synthetic oligonucleotide
gcgcatggactgcggg

SEQ ID NO: 426 - DNA, 16 bp, Artificial sequence
  Synthetic oligonucleotide
tggaagtacacaggct

SEQ ID NO: 427 - DNA, 16 bp, Artificial sequence
  Synthetic oligonucleotide
gtctatggccccgggc

SEQ ID NO: 428 - DNA, 16 bp, Artificial sequence
  Synthetic oligonucleotide
gcataggccaacgcag

SEQ ID NO: 429 - DNA, 16 bp, Artificial sequence
  Synthetic oligonucleotide
aaacaggcccgcagcc

SEQ ID NO: 430 - DNA, 16 bp, Artificial sequence
  Synthetic oligonucleotide
cctacagcggccatgg

SEQ ID NO: 431 - DNA, 16 bp, Artificial sequence
  Synthetic oligonucleotide
gtgctaaccgtgtgtg

SEQ ID NO: 432 - DNA, 16 bp, Artificial sequence
  Synthetic oligonucleotide
gtccagttggccctga

SEQ ID NO: 433 - DNA, 16 bp, Artificial sequence
  Synthetic oligonucleotide
aaccaccgaagctggg

SEQ ID NO: 434 - DNA, 16 bp, Artificial sequence
  Synthetic oligonucleotide
ggaagatggccgggtg

SEQ ID NO: 435 - DNA, 16 bp, Artificial sequence
  Synthetic oligonucleotide
gctacaatgcctagga

SEQ ID NO: 436 - DNA, 16 bp, Artificial sequence
  Synthetic oligonucleotide
ggtcaacgcaggctca

SEQ ID NO: 437 - DNA, 16 bp, Artificial sequence
  Synthetic oligonucleotide
agccaggagcaatcgc

SEQ ID NO: 438 - DNA, 16 bp, Artificial sequence
  Synthetic oligonucleotide
ggcaaccaaggtctga

SEQ ID NO: 439 - DNA, 16 bp, Artificial sequence
  Synthetic oligonucleotide
cgcctagcctgggttc

SEQ ID NO: 440 - DNA, 16 bp, Artificial sequence
  Synthetic oligonucleotide
caccatcacacacgga

SEQ ID NO: 441 - DNA, 16 bp, Artificial sequence
  Synthetic oligonucleotide
gggagaggtgccggtc

SEQ ID NO: 442 - DNA, 16 bp, Artificial sequence
  Synthetic oligonucleotide
caccgagaaggaggta

SEQ ID NO: 443 - DNA, 16 bp, Artificial sequence
  Synthetic oligonucleotide
aaaatctcggccggga

SEQ ID NO: 444 - DNA, 16 bp, Artificial sequence
  Synthetic oligonucleotide
gccaagtggacctggc

SEQ ID NO: 445 - DNA, 16 bp, Artificial sequence
  Synthetic oligonucleotide
gcctgaaacaagtgcc

SEQ ID NO: 446 - DNA, 16 bp, Artificial sequence
  Synthetic oligonucleotide
ccccaggcaatgcata

SEQ ID NO: 447 - DNA, 16 bp, Artificial sequence
  Synthetic oligonucleotide
agaacgataggccagg

SEQ ID NO: 448 - DNA, 16 bp, Artificial sequence
  Synthetic oligonucleotide
tcttttcccggccccc

SEQ ID NO: 449 - DNA, 16 bp, Artificial sequence
  Synthetic oligonucleotide
cggcacggagctgccc

SEQ ID NO: 450 - DNA, 16 bp, Artificial sequence
  Synthetic oligonucleotide
ggtcagttgctgcagg

SEQ ID NO: 451 - DNA, 16 bp, Artificial sequence
  Synthetic oligonucleotide
ggccggccaatgctca

SEQ ID NO: 452 - DNA, 16 bp, Artificial sequence
  Synthetic oligonucleotide
ttgcactggccgggct

SEQ ID NO: 453 - DNA, 16 bp, Artificial sequence
  Synthetic oligonucleotide
cccttagcccacgacc

SEQ ID NO: 454 - DNA, 16 bp, Artificial sequence
  Synthetic oligonucleotide
ctgccagtttgtcccc

SEQ ID NO: 455 - DNA, 16 bp, Artificial sequence
  Synthetic oligonucleotide
tgtaatctgccagttt

SEQ ID NO: 456 - DNA, 16 bp, Artificial sequence
  Synthetic oligonucleotide
cttgtaatctgccagt

SEQ ID NO: 457 - DNA, 16 bp, Artificial sequence
  Synthetic oligonucleotide
ggcaccttgtaatctg

SEQ ID NO: 458 - DNA, 16 bp, Artificial sequence
  Synthetic oligonucleotide
tgtgatgggcatcccc

SEQ ID NO: 459 - DNA, 16 bp, Artificial sequence
  Synthetic oligonucleotide
atacatgaggtccggg

SEQ ID NO: 460 - DNA, 16 bp, Artificial sequence
  Synthetic oligonucleotide
gcccaacccacgctgc

SEQ ID NO: 461 - DNA, 16 bp, Artificial sequence
  Synthetic oligonucleotide
ccccaactgggagagg

SEQ ID NO: 462 - DNA, 16 bp, Artificial sequence
  Synthetic oligonucleotide
tagaacgggcctggcc

SEQ ID NO: 463 - DNA, 16 bp, Artificial sequence
  Synthetic oligonucleotide
tccataggttcccgcc

SEQ ID NO: 464 - DNA, 16 bp, Artificial sequence
  Synthetic oligonucleotide
gggcactaccttcacc

SEQ ID NO: 465 - DNA, 16 bp, Artificial sequence
  Synthetic oligonucleotide
tcccacggattatagg

SEQ ID NO: 466 - DNA, 16 bp, Artificial sequence
  Synthetic oligonucleotide
gcccaggaaggtcgaa

SEQ ID NO: 467 - DNA, 16 bp, Artificial sequence
  Synthetic oligonucleotide
atgcatggaggcaccc

SEQ ID NO: 468 - DNA, 16 bp, Artificial sequence
  Synthetic oligonucleotide
tgcaatggacgcagga

SEQ ID NO: 469 - DNA, 16 bp, Artificial sequence
  Synthetic oligonucleotide
ggccgggtccccaaca

SEQ ID NO: 470 - DNA, 16 bp, Artificial sequence
  Synthetic oligonucleotide
ggccattcccggagct

SEQ ID NO: 471 - DNA, 16 bp, Artificial sequence
  Synthetic oligonucleotide
ccttttctaatcgaag

SEQ ID NO: 472 - DNA, 16 bp, Artificial sequence
  Synthetic oligonucleotide
acctgtttggactgtt

SEQ ID NO: 473 - DNA, 16 bp, Artificial sequence
  Synthetic oligonucleotide
ccaacctgtttggact

SEQ ID NO: 474 - DNA, 16 bp, Artificial sequence
  Synthetic oligonucleotide
ttccaacctgtttgga

SEQ ID NO: 475 - DNA, 16 bp, Artificial sequence
  Synthetic oligonucleotide
cgttttccaacctgtt

SEQ ID NO: 476 - DNA, 16 bp, Artificial sequence
  Synthetic oligonucleotide
ggctctaggacgagcg

SEQ ID NO: 477 - DNA, 16 bp, Artificial sequence
  Synthetic oligonucleotide
cctggctctaggacga

SEQ ID NO: 478 - DNA, 16 bp, Artificial sequence
  Synthetic oligonucleotide
tgtccatgacacctgg

SEQ ID NO: 479 - DNA, 16 bp, Artificial sequence
  Synthetic oligonucleotide
tcatgtccatgacacc

SEQ ID NO: 480 - DNA, 16 bp, Artificial sequence
  Synthetic oligonucleotide
attcatgtccatgaca

SEQ ID NO: 481 - DNA, 16 bp, Artificial sequence
  Synthetic oligonucleotide
ccccacgggcagccac

SEQ ID NO: 482 - DNA, 16 bp, Artificial sequence
  Synthetic oligonucleotide
gggcaccgtggaccgg

SEQ ID NO: 483 - DNA, 16 bp, Artificial sequence
  Synthetic oligonucleotide
catatgcagctgtcag

SEQ ID NO: 484 - DNA, 16 bp, Artificial sequence
  Synthetic oligonucleotide
ccatatgcagctgtca

SEQ ID NO: 485 - DNA, 16 bp, Artificial sequence
  Synthetic oligonucleotide
tgccatatgcagctgt

SEQ ID NO: 486 - DNA, 16 bp, Artificial sequence
  Synthetic oligonucleotide
ttgccatatgcagctg

SEQ ID NO: 487 - DNA, 16 bp, Artificial sequence
  Synthetic oligonucleotide
tttgccatatgcagct

SEQ ID NO: 488 - DNA, 16 bp, Artificial sequence
  Synthetic oligonucleotide
gggttactttgccata

SEQ ID NO: 489 - DNA, 16 bp, Artificial sequence
  Synthetic oligonucleotide
agggttactttgccat

SEQ ID NO: 490 - DNA, 16 bp, Artificial sequence
  Synthetic oligonucleotide
aagggttactttgcca

SEQ ID NO: 491 - DNA, 16 bp, Artificial sequence
  Synthetic oligonucleotide
taagggttactttgcc

SEQ ID NO: 492 - DNA, 16 bp, Artificial sequence
  Synthetic oligonucleotide
gtaagggttactttgc

SEQ ID NO: 493 - DNA, 16 bp, Artificial sequence
  Synthetic oligonucleotide
ggtaagggttactttg

SEQ ID NO: 494 - DNA, 16 bp, Artificial sequence
  Synthetic oligonucleotide
aggtaagggttacttt

SEQ ID NO: 495 - DNA, 16 bp, Artificial sequence
  Synthetic oligonucleotide
gaggtaagggttactt

SEQ ID NO: 496 - DNA, 16 bp, Artificial sequence
  Synthetic oligonucleotide
tgaggtaagggttact

SEQ ID NO: 497 - DNA, 16 bp, Artificial sequence
  Synthetic oligonucleotide
ttgaggtaagggttac

SEQ ID NO: 498 - DNA, 16 bp, Artificial sequence
  Synthetic oligonucleotide
aacccttacctcaatc

SEQ ID NO: 499 - DNA, 16 bp, Artificial sequence
  Synthetic oligonucleotide
tgattgaggtaagggt

SEQ ID NO: 500 - DNA, 16 bp, Artificial sequence
  Synthetic oligonucleotide
ttgattgaggtaaggg

SEQ ID NO: 501 - DNA, 16 bp, Artificial sequence
  Synthetic oligonucleotide
cttgattgaggtaagg

SEQ ID NO: 502 - DNA, 16 bp, Artificial sequence
  Synthetic oligonucleotide
tcttgattgaggtaag

SEQ ID NO: 503 - DNA, 16 bp, Artificial sequence
  Synthetic oligonucleotide
atcttgattgaggtaa

SEQ ID NO: 504 - DNA, 16 bp, Artificial sequence
  Synthetic oligonucleotide
accgctctgtatcttg

SEQ ID NO: 505 - DNA, 16 bp, Artificial sequence
  Synthetic oligonucleotide
aaccgctctgtatctt

SEQ ID NO: 506 - DNA, 16 bp, Artificial sequence
  Synthetic oligonucleotide
agatacagagcggttc

SEQ ID NO: 507 - DNA, 16 bp, Artificial sequence
  Synthetic oligonucleotide
ggaaccgctctgtatc

SEQ ID NO: 508 - DNA, 16 bp, Artificial sequence
  Synthetic oligonucleotide
cggaaccgctctgtat

SEQ ID NO: 509 - DNA, 16 bp, Artificial sequence
  Synthetic oligonucleotide
acggaaccgctctgta

SEQ ID NO: 510 - DNA, 16 bp, Artificial sequence
  Synthetic oligonucleotide
gacggaaccgctctgt

SEQ ID NO: 511 - DNA, 16 bp, Artificial sequence
  Synthetic oligonucleotide
tgacggaaccgctctg

SEQ ID NO: 512 - DNA, 16 bp, Artificial sequence
  Synthetic oligonucleotide
gtgacggaaccgctct

SEQ ID NO: 513 - DNA, 16 bp, Artificial sequence
  Synthetic oligonucleotide
ggtgacggaaccgctc

SEQ ID NO: 514 - DNA, 16 bp, Artificial sequence
  Synthetic oligonucleotide
agcggttccgtcacct

SEQ ID NO: 515 - DNA, 16 bp, Artificial sequence
  Synthetic oligonucleotide
gaggtgacggaaccgc

SEQ ID NO: 516 - DNA, 16 bp, Artificial sequence
  Synthetic oligonucleotide
ggaggtgacggaaccg

SEQ ID NO: 517 - DNA, 16 bp, Artificial sequence
  Synthetic oligonucleotide
aggaggtgacggaacc

SEQ ID NO: 518 - DNA, 16 bp, Artificial sequence
  Synthetic oligonucleotide
taggaggtgacggaac

SEQ ID NO: 519 - DNA, 16 bp, Artificial sequence
  Synthetic oligonucleotide
ttaggaggtgacggaa

SEQ ID NO: 520 - DNA, 16 bp, Artificial sequence
  Synthetic oligonucleotide
gacagggattttagga

SEQ ID NO: 521 - DNA, 16 bp, Artificial sequence
  Synthetic oligonucleotide
ggacagggattttagg

SEQ ID NO: 522 - DNA, 16 bp, Artificial sequence
  Synthetic oligonucleotide
cctgtccctatcatgc

SEQ ID NO: 523 - DNA, 16 bp, Artificial sequence
  Synthetic oligonucleotide
agcatgatagggacag

SEQ ID NO: 524 - DNA, 16 bp, Artificial sequence
  Synthetic oligonucleotide
cagcatgatagggaca

SEQ ID NO: 525 - DNA, 16 bp, Artificial sequence
  Synthetic oligonucleotide
tcagcatgatagggac

SEQ ID NO: 526 - DNA, 16 bp, Artificial sequence
  Synthetic oligonucleotide
gtcagcatgataggga

SEQ ID NO: 527 - DNA, 16 bp, Artificial sequence
  Synthetic oligonucleotide
tgtcagcatgataggg

SEQ ID NO: 528 - DNA, 16 bp, Artificial sequence
  Synthetic oligonucleotide
ctgtcagcatgatagg

SEQ ID NO: 529 - DNA, 16 bp, Artificial sequence
  Synthetic oligonucleotide
gctgtcagcatgatag

SEQ ID NO: 530 - DNA, 16 bp, Artificial sequence
  Synthetic oligonucleotide
tatcatgctgacagct

SEQ ID NO: 531 - DNA, 16 bp, Artificial sequence
  Synthetic oligonucleotide
gaggttgactacaaag

SEQ ID NO: 532 - DNA, 16 bp, Artificial sequence
  Synthetic oligonucleotide
tgagaggttgactaca

SEQ ID NO: 533 - DNA, 16 bp, Artificial sequence
  Synthetic oligonucleotide
tttgagaggttgacta

SEQ ID NO: 534 - DNA, 16 bp, Artificial sequence
  Synthetic oligonucleotide
tgggtttttgagaggt

SEQ ID NO: 535 - DNA, 16 bp, Artificial sequence
  Synthetic oligonucleotide
ggcgatggcacgacca

SEQ ID NO: 536 - DNA, 16 bp, Artificial sequence
  Synthetic oligonucleotide
gtataaggacggccca

SEQ ID NO: 537 - DNA, 16 bp, Artificial sequence
  Synthetic oligonucleotide
tcagatccggcctggc

SEQ ID NO: 538 - DNA, 16 bp, Artificial sequence
  Synthetic oligonucleotide
gtggtgtggcgtgcgc

SEQ ID NO: 539 - DNA, 16 bp, Artificial sequence
  Synthetic oligonucleotide
gaacttactgtctccc

SEQ ID NO: 540 - DNA, 16 bp, Artificial sequence
  Synthetic oligonucleotide
aggcagggccgctgtc

SEQ ID NO: 541 - DNA, 16 bp, Artificial sequence
  Synthetic oligonucleotide
aggattggtgccgccc

SEQ ID NO: 542 - DNA, 16 bp, Artificial sequence
  Synthetic oligonucleotide
aatcagcgggtgatgc

SEQ ID NO: 543 - DNA, 16 bp, Artificial sequence
  Synthetic oligonucleotide
gcccagtggccgccct

SEQ ID NO: 544 - DNA, 16 bp, Artificial sequence
  Synthetic oligonucleotide
ctacagctggtgcggt

SEQ ID NO: 545 - DNA, 16 bp, Artificial sequence
  Synthetic oligonucleotide
cgccaggcttgggccc

SEQ ID NO: 546 - DNA, 16 bp, Artificial sequence
  Synthetic oligonucleotide
gcccagataagaagcc

SEQ ID NO: 547 - DNA, 16 bp, Artificial sequence
  Synthetic oligonucleotide
ggctagttcatgccgg

SEQ ID NO: 548 - DNA, 16 bp, Artificial sequence
  Synthetic oligonucleotide
acggcctgggcacacg

SEQ ID NO: 549 - DNA, 16 bp, Artificial sequence
  Synthetic oligonucleotide
ggaaacggcctgggca

SEQ ID NO: 550 - DNA, 16 bp, Artificial sequence
  Synthetic oligonucleotide
aagggaaacggcctgg

SEQ ID NO: 551 - DNA, 16 bp, Artificial sequence
  Synthetic oligonucleotide
cgcaagggaaacggcc

SEQ ID NO: 552 - DNA, 16 bp, Artificial sequence
  Synthetic oligonucleotide
tgcgcaagggaaacgg

SEQ ID NO: 553 - DNA, 16 bp, Artificial sequence
  Synthetic oligonucleotide
gctgcgcaagggaaac

SEQ ID NO: 554 - DNA, 16 bp, Artificial sequence
  Synthetic oligonucleotide
cccttgcgcagctctg

SEQ ID NO: 555 - DNA, 16 bp, Artificial sequence
  Synthetic oligonucleotide
cacacagagctgcgca

SEQ ID NO: 556 - DNA, 16 bp, Artificial sequence
  Synthetic oligonucleotide
gaagccccctgcacac

SEQ ID NO: 557 - DNA, 16 bp, Artificial sequence
  Synthetic oligonucleotide
agagaagccccctgca

SEQ ID NO: 558 - DNA, 16 bp, Artificial sequence
  Synthetic oligonucleotide
ccaagtgagcagccac

SEQ ID NO: 559 - DNA, 16 bp, Artificial sequence
  Synthetic oligonucleotide
gaccaagtgagcagcc

SEQ ID NO: 560 - DNA, 16 bp, Artificial sequence
  Synthetic oligonucleotide
gggaccaagtgagcag

SEQ ID NO: 561 - DNA, 16 bp, Artificial sequence
  Synthetic oligonucleotide
cactaggccctgccag

SEQ ID NO: 562 - DNA, 16 bp, Artificial sequence
  Synthetic oligonucleotide
gagcgggggtctgtga

SEQ ID NO: 563 - DNA, 16 bp, Artificial sequence
  Synthetic oligonucleotide
cagcactttgtccggg

SEQ ID NO: 564 - DNA, 16 bp, Artificial sequence
  Synthetic oligonucleotide
acctacggcaagcgca

SEQ ID NO: 565 - DNA, 16 bp, Artificial sequence
  Synthetic oligonucleotide
taccaggatctccccc

SEQ ID NO: 566 - DNA, 16 bp, Artificial sequence
  Synthetic oligonucleotide
gctagaggagcggcac

SEQ ID NO: 567 - DNA, 16 bp, Artificial sequence
  Synthetic oligonucleotide
gcccatctcacgcccc

SEQ ID NO: 568 - DNA, 16 bp, Artificial sequence
  Synthetic oligonucleotide
ccagaggccacggcca

SEQ ID NO: 569 - DNA, 16 bp, Artificial sequence
  Synthetic oligonucleotide
ccgcacacccctcggt

SEQ ID NO: 570 - DNA, 16 bp, Artificial sequence
  Synthetic oligonucleotide
caggccgccctgtgcg

SEQ ID NO: 571 - DNA, 16 bp, Artificial sequence
  Synthetic oligonucleotide
cccaagcatttccagc

SEQ ID NO: 572 - DNA, 16 bp, Artificial sequence
  Synthetic oligonucleotide
agttccaccctgtccc

SEQ ID NO: 573 - DNA, 16 bp, Artificial sequence
  Synthetic oligonucleotide
tagagacacctccagc

SEQ ID NO: 574 - DNA, 16 bp, Artificial sequence
  Synthetic oligonucleotide
caatagagacacctcc

SEQ ID NO: 575 - DNA, 16 bp, Artificial sequence
  Synthetic oligonucleotide
ccgcaatagagacacc

SEQ ID NO: 576 - DNA, 16 bp, Artificial sequence
  Synthetic oligonucleotide
gaccgcaatagagaca

SEQ ID NO: 577 - DNA, 16 bp, Artificial sequence
  Synthetic oligonucleotide
gggaccgcaatagaga

SEQ ID NO: 578 - DNA, 16 bp, Artificial sequence
  Synthetic oligonucleotide
ctattgcggtccctgg

SEQ ID NO: 579 - DNA, 16 bp, Artificial sequence
  Synthetic oligonucleotide
agccagggaccgcaat

SEQ ID NO: 580 - DNA, 16 bp, Artificial sequence
  Synthetic oligonucleotide
gcccacccgctcttcc

SEQ ID NO: 581 - DNA, 16 bp, Artificial sequence
  Synthetic oligonucleotide
tggaaccccggtgccc

SEQ ID NO: 582 - DNA, 16 bp, Artificial sequence
  Synthetic oligonucleotide
cttcaccgtttggcca

SEQ ID NO: 583 - DNA, 16 bp, Artificial sequence
  Synthetic oligonucleotide
cgcggagccaggccct

SEQ ID NO: 584 - DNA, 16 bp, Artificial sequence
  Synthetic oligonucleotide
ccccagagtcccgcag

SEQ ID NO: 585 - DNA, 16 bp, Artificial sequence
  Synthetic oligonucleotide
acacgaagggcccctc

SEQ ID NO: 586 - DNA, 16 bp, Artificial sequence
  Synthetic oligonucleotide
gcagactgatagggcc

SEQ ID NO: 587 - DNA, 16 bp, Artificial sequence
  Synthetic oligonucleotide
ggatagccggccccgc

SEQ ID NO: 588 - DNA, 16 bp, Artificial sequence
  Synthetic oligonucleotide
cgcggccggaagcttc

SEQ ID NO: 589 - DNA, 16 bp, Artificial sequence
  Synthetic oligonucleotide
cagagcataggagagg

SEQ ID NO: 590 - DNA, 16 bp, Artificial sequence
  Synthetic oligonucleotide
agcagagcataggaga

SEQ ID NO: 591 - DNA, 16 bp, Artificial sequence
  Synthetic oligonucleotide
gggagcagagcatagg

SEQ ID NO: 592 - DNA, 16 bp, Artificial sequence
  Synthetic oligonucleotide
gccagccacggctgtc

SEQ ID NO: 593 - DNA, 16 bp, Artificial sequence
  Synthetic oligonucleotide
gctgacggcacgcaca

SEQ ID NO: 594 - DNA, 16 bp, Artificial sequence
  Synthetic oligonucleotide
tggggatggctcgggg

SEQ ID NO: 595 - DNA, 16 bp, Artificial sequence
  Synthetic oligonucleotide
caccagggctccgcct

SEQ ID NO: 596 - DNA, 16 bp, Artificial sequence
  Synthetic oligonucleotide
ggcacacggctcaggg

SEQ ID NO: 597 - DNA, 16 bp, Artificial sequence
  Synthetic oligonucleotide
cagcaagtggctgccc

SEQ ID NO: 598 - DNA, 16 bp, Artificial sequence
  Synthetic oligonucleotide
tgggagtggtactgca

SEQ ID NO: 599 - DNA, 16 bp, Artificial sequence
  Synthetic oligonucleotide
tgccatgggtctggca

SEQ ID NO: 600 - DNA, 16 bp, Artificial sequence
  Synthetic oligonucleotide
gctcctcacctggtcc

SEQ ID NO: 601 - DNA, 16 bp, Artificial sequence
  Synthetic oligonucleotide
aggacggctcctcacc

SEQ ID NO: 602 - DNA, 16 bp, Artificial sequence
  Synthetic oligonucleotide
gaggagccgtcctgcg

SEQ ID NO: 603 - DNA, 16 bp, Artificial sequence
  Synthetic oligonucleotide
gctgcgcaggacggct

SEQ ID NO: 604 - DNA, 16 bp, Artificial sequence
  Synthetic oligonucleotide
gggcgaaccacccacc

SEQ ID NO: 605 - DNA, 16 bp, Artificial sequence
  Synthetic oligonucleotide
gcccaaaggatctgcc

SEQ ID NO: 606 - DNA, 16 bp, Artificial sequence
  Synthetic oligonucleotide
ccctattgtcccacca

SEQ ID NO: 607 - DNA, 16 bp, Artificial sequence
  Synthetic oligonucleotide
gtgcactctaggctta

SEQ ID NO: 608 - DNA, 16 bp, Artificial sequence
  Synthetic oligonucleotide
ggacacagcggctgcc

SEQ ID NO: 609 - DNA, 16 bp, Artificial sequence
  Synthetic oligonucleotide
ccgcaggtttctgtgg

SEQ ID NO: 610 - DNA, 16 bp, Artificial sequence
  Synthetic oligonucleotide
accgataggatcggag

SEQ ID NO: 611 - DNA, 16 bp, Artificial sequence
  Synthetic oligonucleotide
ggccgtcacaactttt

SEQ ID NO: 612 - DNA, 16 bp, Artificial sequence
  Synthetic oligonucleotide
ctggaacctcctactg

SEQ ID NO: 613 - DNA, 16 bp, Artificial sequence
  Synthetic oligonucleotide
ggccgaatgcttgagg

SEQ ID NO: 614 - DNA, 16 bp, Artificial sequence
  Synthetic oligonucleotide
tcacagggccccctca

SEQ ID NO: 615 - DNA, 16 bp, Artificial sequence
  Synthetic oligonucleotide
ggccttacctgggcac

SEQ ID NO: 616 - DNA, 16 bp, Artificial sequence
  Synthetic oligonucleotide
ccgcaagccaccaggg

SEQ ID NO: 617 - DNA, 16 bp, Artificial sequence
  Synthetic oligonucleotide
atctccccctgattgg

SEQ ID NO: 618 - DNA, 16 bp, Artificial sequence
  Synthetic oligonucleotide
caggatctccccctga

SEQ ID NO: 619 - DNA, 16 bp, Artificial sequence
  Synthetic oligonucleotide
gccccgtcctgactcc

SEQ ID NO: 620 - DNA, 16 bp, Artificial sequence
  Synthetic oligonucleotide
gagccccgtcctgact

SEQ ID NO: 621 - DNA, 16 bp, Artificial sequence
  Synthetic oligonucleotide
ctgagcttctcggcac

SEQ ID NO: 622 - DNA, 16 bp, Artificial sequence
  Synthetic oligonucleotide
aactgagcttctcggc

SEQ ID NO: 623 - DNA, 16 bp, Artificial sequence
  Synthetic oligonucleotide
ggaactgagcttctcg

SEQ ID NO: 624 - DNA, 16 bp, Artificial sequence
  Synthetic oligonucleotide
cgacacccgacccgag

SEQ ID NO: 625 - DNA, 16 bp, Artificial sequence
  Synthetic oligonucleotide
gtccaggtggcagctc

SEQ ID NO: 626 - DNA, 16 bp, Artificial sequence
  Synthetic oligonucleotide
ccggacttcatcaaag

SEQ ID NO: 627 - DNA, 16 bp, Artificial sequence
  Synthetic oligonucleotide
gtccaggccgggatgg

SEQ ID NO: 628 - DNA, 16 bp, Artificial sequence
  Synthetic oligonucleotide
gcggataatggtgggc

SEQ ID NO: 629 - DNA, 16 bp, Artificial sequence
  Synthetic oligonucleotide
ggctgggcggataatg

SEQ ID NO: 630 - DNA, 16 bp, Artificial sequence
  Synthetic oligonucleotide
cttcaaactcggctct

SEQ ID NO: 631 - DNA, 16 bp, Artificial sequence
  Synthetic oligonucleotide
gtgaagagccccgtcc

SEQ ID NO: 632 - DNA, 16 bp, Artificial sequence
  Synthetic oligonucleotide
ggtgaagagccccgtc

SEQ ID NO: 633 - DNA, 16 bp, Artificial sequence
  Synthetic oligonucleotide
caaactcggctctttg

SEQ ID NO: 634 - DNA, 16 bp, Artificial sequence
  Synthetic oligonucleotide
tcaaactcggctcttt

SEQ ID NO: 635 - DNA, 16 bp, Artificial sequence
  Synthetic oligonucleotide
ttcaaactcggctctt

SEQ ID NO: 636 - DNA, 16 bp, Artificial sequence
  Synthetic oligonucleotide
cacttcaaactcggct

SEQ ID NO: 637 - DNA, 16 bp, Artificial sequence
  Synthetic oligonucleotide
acacttcaaactcggc

SEQ ID NO: 638 - DNA, 16 bp, Artificial sequence
  Synthetic oligonucleotide
cacacttcaaactcgg

SEQ ID NO: 639 - DNA, 16 bp, Artificial sequence
  Synthetic oligonucleotide
aacacacttcaaactc

SEQ ID NO: 640 - DNA, 16 bp, Artificial sequence
  Synthetic oligonucleotide
caacacacttcaaact

SEQ ID NO: 641 - DNA, 16 bp, Artificial sequence
  Synthetic oligonucleotide
tcaacacacttcaaac

SEQ ID NO: 642 - DNA, 16 bp, Artificial sequence
  Synthetic oligonucleotide
gagatcaacacacttc

SEQ ID NO: 643 - DNA, 16 bp, Artificial sequence
  Synthetic oligonucleotide
acgagatcaacacact

SEQ ID NO: 644 - DNA, 16 bp, Artificial sequence
  Synthetic oligonucleotide
cacgagatcaacacac

SEQ ID NO: 645 - DNA, 16 bp, Artificial sequence
  Synthetic oligonucleotide
accacgagatcaacac

SEQ ID NO: 646 - DNA, 16 bp, Artificial sequence
  Synthetic oligonucleotide
tgagaccacgagatca

SEQ ID NO: 647 - DNA, 16 bp, Artificial sequence
  Synthetic oligonucleotide
tctgagaccacgagat

SEQ ID NO: 648 - DNA, 16 bp, Artificial sequence
  Synthetic oligonucleotide
ctctgagaccacgaga

SEQ ID NO: 649 - DNA, 16 bp, Artificial sequence
  Synthetic oligonucleotide
ttttttatgaccgtgg

SEQ ID NO: 650 - DNA, 16 bp, Artificial sequence
  Synthetic oligonucleotide
gcacacttttttatga

SEQ ID NO: 651 - DNA, 16 bp, Artificial sequence
  Synthetic oligonucleotide
ggcacacttttttatg

SEQ ID NO: 652 - DNA, 16 bp, Artificial sequence
  Synthetic oligonucleotide
tcggcacactttttta

SEQ ID NO: 653 - DNA, 16 bp, Artificial sequence
  Synthetic oligonucleotide
ctcggcacactttttt

SEQ ID NO: 654 - DNA, 16 bp, Artificial sequence
  Synthetic oligonucleotide
tctcggcacacttttt

SEQ ID NO: 655 - DNA, 16 bp, Artificial sequence
  Synthetic oligonucleotide
cttctcggcacacttt

SEQ ID NO: 656 - DNA, 16 bp, Artificial sequence
  Synthetic oligonucleotide
acccgacccgagcgac

SEQ ID NO: 657 - DNA, 16 bp, Artificial sequence
  Synthetic oligonucleotide
tctcaggcgacacccg

SEQ ID NO: 658 - DNA, 16 bp, Artificial sequence
  Synthetic oligonucleotide
cctcacggtcgccgcc

SEQ ID NO: 659 - DNA, 16 bp, Artificial sequence
  Synthetic oligonucleotide
ggcctcacggtcgccg

SEQ ID NO: 660 - DNA, 16 bp, Artificial sequence
  Synthetic oligonucleotide
tcccggctcggcctca

SEQ ID NO: 661 - DNA, 16 bp, Artificial sequence
  Synthetic oligonucleotide
gctccccgcccgcccg

SEQ ID NO: 662 - DNA, 16 bp, Artificial sequence
  Synthetic oligonucleotide
ttgctccccgcccgcc

SEQ ID NO: 663 - DNA, 16 bp, Artificial sequence
  Synthetic oligonucleotide
gttgctccccgcccgc

SEQ ID NO: 664 - DNA, 16 bp, Artificial sequence
  Synthetic oligonucleotide
cgttgctccccgcccg

SEQ ID NO: 665 - DNA, 16 bp, Artificial sequence
  Synthetic oligonucleotide
gccgttgctccccgcc

SEQ ID NO: 666 - DNA, 16 bp, Artificial sequence
  Synthetic oligonucleotide
tagccgttgctccccg

SEQ ID NO: 667 - DNA, 16 bp, Artificial sequence
  Synthetic oligonucleotide
gtagccgttgctcccc

SEQ ID NO: 668 - DNA, 16 bp, Artificial sequence
  Synthetic oligonucleotide
ctgtagccgttgctcc

SEQ ID NO: 669 - DNA, 16 bp, Artificial sequence
  Synthetic oligonucleotide
tctgtagccgttgctc

SEQ ID NO: 670 - DNA, 16 bp, Artificial sequence
  Synthetic oligonucleotide
gtctgtagccgttgct

SEQ ID NO: 671 - DNA, 16 bp, Artificial sequence
  Synthetic oligonucleotide
gacctggccccgcggc

SEQ ID NO: 672 - DNA, 16 bp, Artificial sequence
  Synthetic oligonucleotide
cgacctggccccgcgg

SEQ ID NO: 673 - DNA, 16 bp, Artificial sequence
  Synthetic oligonucleotide
acgacctggccccgcg

SEQ ID NO: 674 - DNA, 16 bp, Artificial sequence
  Synthetic oligonucleotide
caacgacctggccccg

SEQ ID NO: 675 - DNA, 16 bp, Artificial sequence
  Synthetic oligonucleotide
tcaacgacctggcccc

SEQ ID NO: 676 - DNA, 16 bp, Artificial sequence
  Synthetic oligonucleotide
ctcaacgacctggccc

SEQ ID NO: 677 - DNA, 16 bp, Artificial sequence
  Synthetic oligonucleotide
cctcaacgacctggcc

SEQ ID NO: 678 - DNA, 16 bp, Artificial sequence
  Synthetic oligonucleotide
ccctcaacgacctggc

SEQ ID NO: 679 - DNA, 16 bp, Artificial sequence
  Synthetic oligonucleotide
ctgcagtttgttgacc

SEQ ID NO: 680 - DNA, 16 bp, Artificial sequence
  Synthetic oligonucleotide
gccgatggagctgaag

SEQ ID NO: 681 - DNA, 16 bp, Artificial sequence
  Synthetic oligonucleotide
ggccgatggagctgaa

SEQ ID NO: 682 - DNA, 16 bp, Artificial sequence
  Synthetic oligonucleotide
aaggaagtcccggccc

SEQ ID NO: 683 - DNA, 16 bp, Artificial sequence
  Synthetic oligonucleotide
gaaggaagtcccggcc

SEQ ID NO: 684 - DNA, 16 bp, Artificial sequence
  Synthetic oligonucleotide
gattcctgaaccgcgg

SEQ ID NO: 685 - DNA, 16 bp, Artificial sequence
  Synthetic oligonucleotide
acgattcctgaaccgc

SEQ ID NO: 686 - DNA, 16 bp, Artificial sequence
  Synthetic oligonucleotide
tgacgattcctgaacc

SEQ ID NO: 687 - DNA, 16 bp, Artificial sequence
  Synthetic oligonucleotide
gtgacgattcctgaac

SEQ ID NO: 688 - DNA, 16 bp, Artificial sequence
  Synthetic oligonucleotide
ggtgacgattcctgaa

SEQ ID NO: 689 - DNA, 16 bp, Artificial sequence
  Synthetic oligonucleotide
cgggtgacgattcctg

SEQ ID NO: 690 - DNA, 16 bp, Artificial sequence
  Synthetic oligonucleotide
cgccgggtgacgattc

SEQ ID NO: 691 - DNA, 16 bp, Artificial sequence
  Synthetic oligonucleotide
tgagaggccgccgggt

SEQ ID NO: 692 - DNA, 16 bp, Artificial sequence
  Synthetic oligonucleotide
aatgagaggccgccgg

SEQ ID NO: 693 - DNA, 16 bp, Artificial sequence
  Synthetic oligonucleotide
gaatgagaggccgccg

SEQ ID NO: 694 - DNA, 16 bp, Artificial sequence
  Synthetic oligonucleotide
gcagaatgagaggccg

SEQ ID NO: 695 - DNA, 16 bp, Artificial sequence
  Synthetic oligonucleotide
caaaaactcggcatgt

SEQ ID NO: 696 - DNA, 16 bp, Artificial sequence
  Synthetic oligonucleotide
gcaaaaactcggcatg

SEQ ID NO: 697 - DNA, 16 bp, Artificial sequence
  Synthetic oligonucleotide
acttgcagtgcaaaaa

SEQ ID NO: 698 - DNA, 16 bp, Artificial sequence
  Synthetic oligonucleotide
ggacttgcagtgcaaa

SEQ ID NO: 699 - DNA, 16 bp, Artificial sequence
  Synthetic oligonucleotide
ttggacttgcagtgca

SEQ ID NO: 700 - DNA, 16 bp, Artificial sequence
  Synthetic oligonucleotide
tttttggacttgcagt

SEQ ID NO: 701 - DNA, 16 bp, Artificial sequence
  Synthetic oligonucleotide
ctttttggacttgcag

SEQ ID NO: 702 - DNA, 16 bp, Artificial sequence
  Synthetic oligonucleotide
aactttttggacttgc

SEQ ID NO: 703 - DNA, 16 bp, Artificial sequence
  Synthetic oligonucleotide
aaactttttggacttg

SEQ ID NO: 704 - DNA, 16 bp, Artificial sequence
  Synthetic oligonucleotide
taaactttttggactt

SEQ ID NO: 705 - DNA, 16 bp, Artificial sequence
  Synthetic oligonucleotide
gtaaactttttggact

SEQ ID NO: 706 - DNA, 16 bp, Artificial sequence
  Synthetic oligonucleotide
tgtaaactttttggac

SEQ ID NO: 707 - DNA, 16 bp, Artificial sequence
  Synthetic oligonucleotide
tgccggacttcatcaa

SEQ ID NO: 708 - DNA, 16 bp, Artificial sequence
  Synthetic oligonucleotide
ctgccggacttcatca

SEQ ID NO: 709 - DNA, 16 bp, Artificial sequence
  Synthetic oligonucleotide
tcctgccggacttcat

SEQ ID NO: 710 - DNA, 16 bp, Artificial sequence
  Synthetic oligonucleotide
atctcctgccggactt

SEQ ID NO: 711 - DNA, 16 bp, Artificial sequence
  Synthetic oligonucleotide
aatctcctgccggact

SEQ ID NO: 712 - DNA, 16 bp, Artificial sequence
  Synthetic oligonucleotide
cttcaatctcctgccg

SEQ ID NO: 713 - DNA, 16 bp, Artificial sequence
  Synthetic oligonucleotide
tcgaaggttgatgggc

SEQ ID NO: 714 - DNA, 16 bp, Artificial sequence
  Synthetic oligonucleotide
ctcgaaggttgatggg

SEQ ID NO: 715 - DNA, 16 bp, Artificial sequence
  Synthetic oligonucleotide
actcgaaggttgatgg

SEQ ID NO: 716 - DNA, 16 bp, Artificial sequence
  Synthetic oligonucleotide
atgagggtcaagttca

SEQ ID NO: 717 - DNA, 16 bp, Artificial sequence
  Synthetic oligonucleotide
cgatgagggtcaagtt

SEQ ID NO: 718 - DNA, 16 bp, Artificial sequence
  Synthetic oligonucleotide
tcgatgagggtcaagt

SEQ ID NO: 719 - DNA, 16 bp, Artificial sequence
  Synthetic oligonucleotide
gtcgatgagggtcaag

SEQ ID NO: 720 - DNA, 16 bp, Artificial sequence
  Synthetic oligonucleotide
aggtcgatgagggtca

SEQ ID NO: 721 - DNA, 16 bp, Artificial sequence
  Synthetic oligonucleotide
ggaggtcgatgagggt

SEQ ID NO: 722 - DNA, 16 bp, Artificial sequence
  Synthetic oligonucleotide
ccgggaggtcgatgag

SEQ ID NO: 723 - DNA, 16 bp, Artificial sequence
  Synthetic oligonucleotide
atacccgggaggtcga

SEQ ID NO: 724 - DNA, 16 bp, Artificial sequence
  Synthetic oligonucleotide
tgatacccgggaggtc

SEQ ID NO: 725 - DNA, 16 bp, Artificial sequence
  Synthetic oligonucleotide
ggtgatacccgggagg

SEQ ID NO: 726 - DNA, 16 bp, Artificial sequence
  Synthetic oligonucleotide
tggtgatacccgggag

SEQ ID NO: 727 - DNA, 16 bp, Artificial sequence
  Synthetic oligonucleotide
ttggtgatacccggga

SEQ ID NO: 728 - DNA, 16 bp, Artificial sequence
  Synthetic oligonucleotide
ccttggtgatacccgg

SEQ ID NO: 729 - DNA, 16 bp, Artificial sequence
  Synthetic oligonucleotide
ccttgatctggtactc

SEQ ID NO: 730 - DNA, 16 bp, Artificial sequence
  Synthetic oligonucleotide
tccttgatctggtact

SEQ ID NO: 731 - DNA, 16 bp, Artificial sequence
  Synthetic oligonucleotide
tgtccttgatctggta

SEQ ID NO: 732 - DNA, 16 bp, Artificial sequence
  Synthetic oligonucleotide
catgtccttgatctgg

SEQ ID NO: 733 - DNA, 16 bp, Artificial sequence
  Synthetic oligonucleotide
atcatgtccttgatct

SEQ ID NO: 734 - DNA, 16 bp, Artificial sequence
  Synthetic oligonucleotide
gatcatgtccttgatc

SEQ ID NO: 735 - DNA, 16 bp, Artificial sequence
  Synthetic oligonucleotide
ggatcatgtccttgat

SEQ ID NO: 736 - DNA, 16 bp, Artificial sequence
  Synthetic oligonucleotide
aatgaggctgctctcc

SEQ ID NO: 737 - DNA, 16 bp, Artificial sequence
  Synthetic oligonucleotide
gccagaatgaggctgc

SEQ ID NO: 738 - DNA, 16 bp, Artificial sequence
  Synthetic oligonucleotide
ggccaggtccatgttg

SEQ ID NO: 739 - DNA, 16 bp, Artificial sequence
  Synthetic oligonucleotide
ggtccgtaggccttgg

SEQ ID NO: 740 - DNA, 16 bp, Artificial sequence
  Synthetic oligonucleotide
caccgatggtccgtag

SEQ ID NO: 741 - DNA, 16 bp, Artificial sequence
  Synthetic oligonucleotide
acgggagcaacttgtt

SEQ ID NO: 742 - DNA, 16 bp, Artificial sequence
  Synthetic oligonucleotide
ctcaacgggagcaact

SEQ ID NO: 743 - DNA, 16 bp, Artificial sequence
  Synthetic oligonucleotide
tctcaacgggagcaac

SEQ ID NO: 744 - DNA, 16 bp, Artificial sequence
  Synthetic oligonucleotide
cacggatgtccttctt

SEQ ID NO: 745 - DNA, 16 bp, Artificial sequence
  Synthetic oligonucleotide
tgcacggatgtccttc

SEQ ID NO: 746 - DNA, 16 bp, Artificial sequence
  Synthetic oligonucleotide
ctgcacggatgtcctt

SEQ ID NO: 747 - DNA, 16 bp, Artificial sequence
  Synthetic oligonucleotide
tgctgcacggatgtcc

SEQ ID NO: 748 - DNA, 16 bp, Artificial sequence
  Synthetic oligonucleotide
gtgctgcacggatgtc

SEQ ID NO: 749 - DNA, 16 bp, Artificial sequence
  Synthetic oligonucleotide
agtgctgcacggatgt

SEQ ID NO: 750 - DNA, 16 bp, Artificial sequence
  Synthetic oligonucleotide
cagtgctgcacggatg

SEQ ID NO: 751 - DNA, 16 bp, Artificial sequence
  Synthetic oligonucleotide
gccagtgctgcacgga

SEQ ID NO: 752 - DNA, 16 bp, Artificial sequence
  Synthetic oligonucleotide
tgccagtgctgcacgg

SEQ ID NO: 753 - DNA, 16 bp, Artificial sequence
  Synthetic oligonucleotide
ctgccagtgctgcacg

SEQ ID NO: 754 - DNA, 16 bp, Artificial sequence
  Synthetic oligonucleotide
agctgccagtgctgca

SEQ ID NO: 755 - DNA, 16 bp, Artificial sequence
  Synthetic oligonucleotide
tgccggtaggccgggt

SEQ ID NO: 756 - DNA, 16 bp, Artificial sequence
  Synthetic oligonucleotide
ccgaaagttcttgtac

SEQ ID NO: 757 - DNA, 16 bp, Artificial sequence
  Synthetic oligonucleotide
gggccgaaagttcttg

SEQ ID NO: 758 - DNA, 16 bp, Artificial sequence
  Synthetic oligonucleotide
cgggccgaaagttctt

SEQ ID NO: 759 - DNA, 16 bp, Artificial sequence
  Synthetic oligonucleotide
tcgggccgaaagttct

SEQ ID NO: 760 - DNA, 16 bp, Artificial sequence
  Synthetic oligonucleotide
cgtcgggccgaaagtt

SEQ ID NO: 761 - DNA, 16 bp, Artificial sequence
  Synthetic oligonucleotide
ggctttggttttgcgg

SEQ ID NO: 762 - DNA, 16 bp, Artificial sequence
  Synthetic oligonucleotide
atccaccccaaactgc

SEQ ID NO: 763 - DNA, 16 bp, Artificial sequence
  Synthetic oligonucleotide
agtgtccacctgatct

SEQ ID NO: 764 - DNA, 16 bp, Artificial sequence
  Synthetic oligonucleotide
agagtgtccacctgat

SEQ ID NO: 765 - DNA, 16 bp, Artificial sequence
  Synthetic oligonucleotide
cagagtgtccacctga

SEQ ID NO: 766 - DNA, 16 bp, Artificial sequence
  Synthetic oligonucleotide
ccagagtgtccacctg

SEQ ID NO: 767 - DNA, 16 bp, Artificial sequence
  Synthetic oligonucleotide
ctccagagtgtccacc

SEQ ID NO: 768 - DNA, 16 bp, Artificial sequence
  Synthetic oligonucleotide
ccggagagctccagag

SEQ ID NO: 769 - DNA, 16 bp, Artificial sequence
  Synthetic oligonucleotide
ccccggagagctccag

SEQ ID NO: 770 - DNA, 16 bp, Artificial sequence
  Synthetic oligonucleotide
tgcgattgattcgggc

SEQ ID NO: 771 - DNA, 16 bp, Artificial sequence
  Synthetic oligonucleotide
atgcgattgattcggg

SEQ ID NO: 772 - DNA, 16 bp, Artificial sequence
  Synthetic oligonucleotide
gaagatgcgattgatt

SEQ ID NO: 773 - DNA, 16 bp, Artificial sequence
  Synthetic oligonucleotide
ggaagatgcgattgat

SEQ ID NO: 774 - DNA, 16 bp, Artificial sequence
  Synthetic oligonucleotide
tggaagatgcgattga

SEQ ID NO: 775 - DNA, 16 bp, Artificial sequence
  Synthetic oligonucleotide
gtggaagatgcgattg

SEQ ID NO: 776 - DNA, 16 bp, Artificial sequence
  Synthetic oligonucleotide
caaatgggaaccgctc

SEQ ID NO: 777 - DNA, 16 bp, Artificial sequence
  Synthetic oligonucleotide
tcaaatgggaaccgct

SEQ ID NO: 778 - DNA, 16 bp, Artificial sequence
  Synthetic oligonucleotide
ctcaaatgggaaccgc

SEQ ID NO: 779 - DNA, 16 bp, Artificial sequence
  Synthetic oligonucleotide
gctcaaatgggaaccg

SEQ ID NO: 780 - DNA, 16 bp, Artificial sequence
  Synthetic oligonucleotide
agctcaaatgggaacc

SEQ ID NO: 781 - DNA, 16 bp, Artificial sequence
  Synthetic oligonucleotide
caccagctcaaatggg

SEQ ID NO: 782 - DNA, 16 bp, Artificial sequence
  Synthetic oligonucleotide
ctccatggatgttctt

SEQ ID NO: 783 - DNA, 16 bp, Artificial sequence
  Synthetic oligonucleotide
tgaaaagcccggtcct

SEQ ID NO: 784 - DNA, 16 bp, Artificial sequence
  Synthetic oligonucleotide
gtgaaaagcccggtcc

SEQ ID NO: 785 - DNA, 16 bp, Artificial sequence
  Synthetic oligonucleotide
gggtgaaaagcccggt

SEQ ID NO: 786 - DNA, 16 bp, Artificial sequence
  Synthetic oligonucleotide
cgaatgccaagtccgg

SEQ ID NO: 787 - DNA, 16 bp, Artificial sequence
  Synthetic oligonucleotide
tcgaatgccaagtccg

SEQ ID NO: 788 - DNA, 16 bp, Artificial sequence
  Synthetic oligonucleotide
cctcgaatgccaagtc

SEQ ID NO: 789 - DNA, 16 bp, Artificial sequence
  Synthetic oligonucleotide
gcctcgaatgccaagt

SEQ ID NO: 790 - DNA, 16 bp, Artificial sequence
  Synthetic oligonucleotide
atggcctcgaatgcca

SEQ ID NO: 791 - DNA, 16 bp, Artificial sequence
  Synthetic oligonucleotide
cacaatggcctcgaat

SEQ ID NO: 792 - DNA, 16 bp, Artificial sequence
  Synthetic oligonucleotide
tgacgacctgcttttt

SEQ ID NO: 793 - DNA, 16 bp, Artificial sequence
  Synthetic oligonucleotide
ttgacgacctgctttt

SEQ ID NO: 794 - DNA, 16 bp, Artificial sequence
  Synthetic oligonucleotide
agcttgacgacctgct

SEQ ID NO: 795 - DNA, 16 bp, Artificial sequence
  Synthetic oligonucleotide
tcagcttgacgacctg

SEQ ID NO: 796 - DNA, 16 bp, Artificial sequence
  Synthetic oligonucleotide
tttcagcttgacgacc

SEQ ID NO: 797 - DNA, 16 bp, Artificial sequence
  Synthetic oligonucleotide
tctttcagcttgacga

SEQ ID NO: 798 - DNA, 16 bp, Artificial sequence
  Synthetic oligonucleotide
gctctttcagcttgac

SEQ ID NO: 799 - DNA, 16 bp, Artificial sequence
  Synthetic oligonucleotide
ggctctttcagcttga

SEQ ID NO: 800 - DNA, 16 bp, Artificial sequence
  Synthetic oligonucleotide
gggctctttcagcttg

SEQ ID NO: 801 - DNA, 16 bp, Artificial sequence
  Synthetic oligonucleotide
cagggctctttcagct

SEQ ID NO: 802 - DNA, 16 bp, Artificial sequence
  Synthetic oligonucleotide
acacatttcagacagg

SEQ ID NO: 803 - DNA, 16 bp, Artificial sequence
  Synthetic oligonucleotide
cgacacatttcagaca

SEQ ID NO: 804 - DNA, 16 bp, Artificial sequence
  Synthetic oligonucleotide
tcgacacatttcagac

SEQ ID NO: 805 - DNA, 16 bp, Artificial sequence
  Synthetic oligonucleotide
gtcgacacatttcaga

SEQ ID NO: 806 - DNA, 16 bp, Artificial sequence
  Synthetic oligonucleotide
aggtcgacacatttca

SEQ ID NO: 807 - DNA, 16 bp, Artificial sequence
  Synthetic oligonucleotide
ccaggtcgacacattt

SEQ ID NO: 808 - DNA, 16 bp, Artificial sequence
  Synthetic oligonucleotide
accaggtcgacacatt

SEQ ID NO: 809 - DNA, 16 bp, Artificial sequence
  Synthetic oligonucleotide
aaccaggtcgacacat

SEQ ID NO: 810 - DNA, 16 bp, Artificial sequence
  Synthetic oligonucleotide
ggataaccaggtcgac

SEQ ID NO: 811 - DNA, 16 bp, Artificial sequence
  Synthetic oligonucleotide
ctggataaccaggtcg

SEQ ID NO: 812 - DNA, 16 bp, Artificial sequence
  Synthetic oligonucleotide
cctggataaccaggtc

SEQ ID NO: 813 - DNA, 16 bp, Artificial sequence
  Synthetic oligonucleotide
tcctggataaccaggt

SEQ ID NO: 814 - DNA, 16 bp, Artificial sequence
  Synthetic oligonucleotide
gctcctggataaccag

SEQ ID NO: 815 - DNA, 16 bp, Artificial sequence
  Synthetic oligonucleotide
ttgattagctcctgga

SEQ ID NO: 816 - DNA, 16 bp, Artificial sequence
  Synthetic oligonucleotide
tattgattagctcctg

SEQ ID NO: 817 - DNA, 16 bp, Artificial sequence
  Synthetic oligonucleotide
gtattgattagctcct

SEQ ID NO: 818 - DNA, 16 bp, Artificial sequence
  Synthetic oligonucleotide
tgtattgattagctcc

SEQ ID NO: 819 - DNA, 16 bp, Artificial sequence
  Synthetic oligonucleotide
ctgtattgattagctc

SEQ ID NO: 820 - DNA, 16 bp, Artificial sequence
  Synthetic oligonucleotide
actgtattgattagct

SEQ ID NO: 821 - DNA, 16 bp, Artificial sequence
  Synthetic oligonucleotide
ctaactgtattgatta

SEQ ID NO: 822 - DNA, 16 bp, Artificial sequence
  Synthetic oligonucleotide
cctaactgtattgatt

SEQ ID NO: 823 - DNA, 16 bp, Artificial sequence
  Synthetic oligonucleotide
tgcctaactgtattga

SEQ ID NO: 824 - DNA, 16 bp, Artificial sequence
  Synthetic oligonucleotide
gtacactgcctaactg

SEQ ID NO: 825 - DNA, 16 bp, Artificial sequence
  Synthetic oligonucleotide
ctggtacactgcctaa

SEQ ID NO: 826 - DNA, 16 bp, Artificial sequence
  Synthetic oligonucleotide
actggtacactgccta

SEQ ID NO: 827 - DNA, 16 bp, Artificial sequence
  Synthetic oligonucleotide
ttactggtacactgcc

SEQ ID NO: 828 - DNA, 16 bp, Artificial sequence
  Synthetic oligonucleotide
cttactggtacactgc

SEQ ID NO: 829 - DNA, 16 bp, Artificial sequence
  Synthetic oligonucleotide
gcttactggtacactg

SEQ ID NO: 830 - DNA, 16 bp, Artificial sequence
  Synthetic oligonucleotide
agcttactggtacact

SEQ ID NO: 831 - DNA, 16 bp, Artificial sequence
  Synthetic oligonucleotide
gagcttactggtacac

SEQ ID NO: 832 - DNA, 16 bp, Artificial sequence
  Synthetic oligonucleotide
actgagcttactggta

SEQ ID NO: 833 - DNA, 16 bp, Artificial sequence
  Synthetic oligonucleotide
aactgagcttactggt

SEQ ID NO: 834 - DNA, 16 bp, Artificial sequence
  Synthetic oligonucleotide
ggaactgagcttactg

SEQ ID NO: 835 - DNA, 16 bp, Artificial sequence
  Synthetic oligonucleotide
aggaactgagcttact

SEQ ID NO: 836 - DNA, 16 bp, Artificial sequence
  Synthetic oligonucleotide
taggaactgagcttac

SEQ ID NO: 837 - DNA, 16 bp, Artificial sequence
  Synthetic oligonucleotide
gtaggaactgagctta

SEQ ID NO: 838 - DNA, 16 bp, Artificial sequence
  Synthetic oligonucleotide
gggtaggaactgagct

SEQ ID NO: 839 - DNA, 16 bp, Artificial sequence
  Synthetic oligonucleotide
ctcctctcgcaaccgg

SEQ ID NO: 840 - DNA, 16 bp, Artificial sequence
  Synthetic oligonucleotide
tgtctcctctcgcaac

SEQ ID NO: 841 - DNA, 16 bp, Artificial sequence
  Synthetic oligonucleotide
ctgtctcctctcgcaa

SEQ ID NO: 842 - DNA, 16 bp, Artificial sequence
  Synthetic oligonucleotide
ctctgtctcctctcgc

SEQ ID NO: 843 - DNA, 16 bp, Artificial sequence
  Synthetic oligonucleotide
gctctgtctcctctcg

SEQ ID NO: 844 - DNA, 16 bp, Artificial sequence
  Synthetic oligonucleotide
cgctctgtctcctctc

SEQ ID NO: 845 - DNA, 16 bp, Artificial sequence
  Synthetic oligonucleotide
ttcgctctgtctcctc

SEQ ID NO: 846 - DNA, 16 bp, Artificial sequence
  Synthetic oligonucleotide
acgattcgctctgtct

SEQ ID NO: 847 - DNA, 16 bp, Artificial sequence
  Synthetic oligonucleotide
gacgattcgctctgtc

SEQ ID NO: 848 - DNA, 16 bp, Artificial sequence
  Synthetic oligonucleotide
tgacgattcgctctgt

SEQ ID NO: 849 - DNA, 16 bp, Artificial sequence
  Synthetic oligonucleotide
agtggtgacgattcgc

SEQ ID NO: 850 - DNA, 16 bp, Artificial sequence
  Synthetic oligonucleotide
taagtggtgacgattc

SEQ ID NO: 851 - DNA, 16 bp, Artificial sequence
  Synthetic oligonucleotide
tgtaagtggtgacgat

SEQ ID NO: 852 - DNA, 16 bp, Artificial sequence
  Synthetic oligonucleotide
atgtaagtggtgacga

SEQ ID NO: 853 - DNA, 16 bp, Artificial sequence
  Synthetic oligonucleotide
gatgtaagtggtgacg

SEQ ID NO: 854 - DNA, 16 bp, Artificial sequence
  Synthetic oligonucleotide
ccggatgtaagtggtg

SEQ ID NO: 855 - DNA, 16 bp, Artificial sequence
  Synthetic oligonucleotide
tcccctcccgttcccg

SEQ ID NO: 856 - DNA, 16 bp, Artificial sequence
  Synthetic oligonucleotide
tctcccctcccgttcc

SEQ ID NO: 857 - DNA, 16 bp, Artificial sequence
  Synthetic oligonucleotide
ttctcccctcccgttc

SEQ ID NO: 858 - DNA, 16 bp, Artificial sequence
  Synthetic oligonucleotide
gttctcccctcccgtt

SEQ ID NO: 859 - DNA, 16 bp, Artificial sequence
  Synthetic oligonucleotide
gcagaagaatctggtc

SEQ ID NO: 860 - DNA, 16 bp, Artificial sequence
  Synthetic oligonucleotide
gatcagcagaagaatc

SEQ ID NO: 861 - DNA, 16 bp, Artificial sequence
  Synthetic oligonucleotide
tcgatcagcagaagaa

SEQ ID NO: 862 - DNA, 16 bp, Artificial sequence
  Synthetic oligonucleotide
tgtcgatcagcagaag

SEQ ID NO: 863 - DNA, 16 bp, Artificial sequence
  Synthetic oligonucleotide
atgtcgatcagcagaa

SEQ ID NO: 864 - DNA, 16 bp, Artificial sequence
  Synthetic oligonucleotide
aatgtcgatcagcaga

SEQ ID NO: 865 - DNA, 16 bp, Artificial sequence
  Synthetic oligonucleotide
tcaatgtcgatcagca

SEQ ID NO: 866 - DNA, 16 bp, Artificial sequence
  Synthetic oligonucleotide
gctcaatgtcgatcag

SEQ ID NO: 867 - DNA, 16 bp, Artificial sequence
  Synthetic oligonucleotide
tgctcaatgtcgatca

SEQ ID NO: 868 - DNA, 16 bp, Artificial sequence
  Synthetic oligonucleotide
gactgctcaatgtcga

SEQ ID NO: 869 - DNA, 16 bp, Artificial sequence
  Synthetic oligonucleotide
aggactgctcaatgtc

SEQ ID NO: 870 - DNA, 16 bp, Artificial sequence
  Synthetic oligonucleotide
gtaggactgctcaatg

SEQ ID NO: 871 - DNA, 16 bp, Artificial sequence
  Synthetic oligonucleotide
tgtaggactgctcaat

SEQ ID NO: 872 - DNA, 16 bp, Artificial sequence
  Synthetic oligonucleotide
atgtaggactgctcaa

SEQ ID NO: 873 - DNA, 16 bp, Artificial sequence
  Synthetic oligonucleotide
tgatgtaggactgctc

SEQ ID NO: 874 - DNA, 16 bp, Artificial sequence
  Synthetic oligonucleotide
ttgatgtaggactgct

SEQ ID NO: 875 - DNA, 16 bp, Artificial sequence
  Synthetic oligonucleotide
tgttgatgtaggactg

SEQ ID NO: 876 - DNA, 16 bp, Artificial sequence
  Synthetic oligonucleotide
gtgttgatgtaggact

SEQ ID NO: 877 - DNA, 16 bp, Artificial sequence
  Synthetic oligonucleotide
cgtgttgatgtaggac

SEQ ID NO: 878 - DNA, 16 bp, Artificial sequence
  Synthetic oligonucleotide
ggcattggcaaacccg

SEQ ID NO: 879 - DNA, 16 bp, Artificial sequence
  Synthetic oligonucleotide
catcaggctgatgttg

SEQ ID NO: 880 - DNA, 16 bp, Artificial sequence
  Synthetic oligonucleotide
tttcatcaggctgatg

SEQ ID NO: 881 - DNA, 16 bp, Artificial sequence
  Synthetic oligonucleotide
agtgactcggcagtca

SEQ ID NO: 882 - DNA, 16 bp, Artificial sequence
  Synthetic oligonucleotide
acagtgactcggcagt

SEQ ID NO: 883 - DNA, 16 bp, Artificial sequence
  Synthetic oligonucleotide
gacagtgactcggcag

SEQ ID NO: 884 - DNA, 16 bp, Artificial sequence
  Synthetic oligonucleotide
ggacagtgactcggca

SEQ ID NO: 885 - DNA, 16 bp, Artificial sequence
  Synthetic oligonucleotide
caggacagtgactcgg

SEQ ID NO: 886 - DNA, 16 bp, Artificial sequence
  Synthetic oligonucleotide
ccaggacagtgactcg

SEQ ID NO: 887 - DNA, 16 bp, Artificial sequence
  Synthetic oligonucleotide
accaggacagtgactc

SEQ ID NO: 888 - DNA, 16 bp, Artificial sequence
  Synthetic oligonucleotide
taccaggacagtgact

SEQ ID NO: 889 - DNA, 16 bp, Artificial sequence
  Synthetic oligonucleotide
tcacggatcttgaggt

SEQ ID NO: 890 - DNA, 16 bp, Artificial sequence
  Synthetic oligonucleotide
catcacggatcttgag

SEQ ID NO: 891 - DNA, 16 bp, Artificial sequence
  Synthetic oligonucleotide
acatcacggatcttga

SEQ ID NO: 892 - DNA, 16 bp, Artificial sequence
  Synthetic oligonucleotide
cacatcacggatcttg

SEQ ID NO: 893 - DNA, 16 bp, Artificial sequence
  Synthetic oligonucleotide
ctccacatcacggatc

SEQ ID NO: 894 - DNA, 16 bp, Artificial sequence
  Synthetic oligonucleotide
cttctccacatcacgg

SEQ ID NO: 895 - DNA, 16 bp, Artificial sequence
  Synthetic oligonucleotide
tgaagatggcgaagac

SEQ ID NO: 896 - DNA, 16 bp, Artificial sequence
  Synthetic oligonucleotide
ttgaagatggcgaaga

SEQ ID NO: 897 - DNA, 16 bp, Artificial sequence
  Synthetic oligonucleotide
gttgaagatggcgaag

SEQ ID NO: 898 - DNA, 16 bp, Artificial sequence
  Synthetic oligonucleotide
ccgcaggtccttgtag

SEQ ID NO: 899 - DNA, 16 bp, Artificial sequence
  Synthetic oligonucleotide
tgccgcaggtccttgt

SEQ ID NO: 900 - DNA, 16 bp, Artificial sequence
  Synthetic oligonucleotide
ggccagctcgatctgc

SEQ ID NO: 901 - DNA, 16 bp, Artificial sequence
  Synthetic oligonucleotide
ggaggaacgaggcctt

SEQ ID NO: 902 - DNA, 16 bp, Artificial sequence
  Synthetic oligonucleotide
cggaggaacgaggcct

SEQ ID NO: 903 - DNA, 16 bp, Artificial sequence
  Synthetic oligonucleotide
ctcggaggaacgaggc

SEQ ID NO: 904 - DNA, 16 bp, Artificial sequence
  Synthetic oligonucleotide
cgccagctcggaggaa

SEQ ID NO: 905 - DNA, 16 bp, Artificial sequence
  Synthetic oligonucleotide
gagaaggtgttctcct

SEQ ID NO: 906 - DNA, 16 bp, Artificial sequence
  Synthetic oligonucleotide
atggagaaggtgttct

SEQ ID NO: 907 - DNA, 16 bp, Artificial sequence
  Synthetic oligonucleotide
ggacttgttgatgatg

SEQ ID NO: 908 - DNA, 16 bp, Artificial sequence
  Synthetic oligonucleotide
tggacttgttgatgat

SEQ ID NO: 909 - DNA, 16 bp, Artificial sequence
  Synthetic oligonucleotide
gatggacttgttgatg

SEQ ID NO: 910 - DNA, 16 bp, Artificial sequence
  Synthetic oligonucleotide
ggatggacttgttgat

SEQ ID NO: 911 - DNA, 16 bp, Artificial sequence
  Synthetic oligonucleotide
cggatggacttgttga

SEQ ID NO: 912 - DNA, 16 bp, Artificial sequence
  Synthetic oligonucleotide
gcggatggacttgttg

SEQ ID NO: 913 - DNA, 16 bp, Artificial sequence
  Synthetic oligonucleotide
cgcggatggacttgtt

SEQ ID NO: 914 - DNA, 16 bp, Artificial sequence
  Synthetic oligonucleotide
catgaggtcgcggatg

SEQ ID NO: 915 - DNA, 16 bp, Artificial sequence
  Synthetic oligonucleotide
gcatgaggtcgcggat

SEQ ID NO: 916 - DNA, 16 bp, Artificial sequence
  Synthetic oligonucleotide
tggcatgaggtcgcgg

SEQ ID NO: 917 - DNA, 16 bp, Artificial sequence
  Synthetic oligonucleotide
tggatgaaggccttcg

SEQ ID NO: 918 - DNA, 16 bp, Artificial sequence
  Synthetic oligonucleotide
ggagtataggtaggcc

SEQ ID NO: 919 - DNA, 16 bp, Artificial sequence
  Synthetic oligonucleotide
gaggagtataggtagg

SEQ ID NO: 920 - DNA, 16 bp, Artificial sequence
  Synthetic oligonucleotide
gccgaggagtataggt

SEQ ID NO: 921 - DNA, 16 bp, Artificial sequence
  Synthetic oligonucleotide
tgccgaggagtatagg

SEQ ID NO: 922 - DNA, 16 bp, Artificial sequence
  Synthetic oligonucleotide
cttgagggcatggtac

SEQ ID NO: 923 - DNA, 16 bp, Artificial sequence
  Synthetic oligonucleotide
tgtcatcgacaggcgg

SEQ ID NO: 924 - DNA, 16 bp, Artificial sequence
  Synthetic oligonucleotide
ggacaccggtcggcgc

SEQ ID NO: 925 - DNA, 16 bp, Artificial sequence
  Synthetic oligonucleotide
tggacaccggtcggcg

SEQ ID NO: 926 - DNA, 16 bp, Artificial sequence
  Synthetic oligonucleotide
tatgctggacaccggt

SEQ ID NO: 927 - DNA, 16 bp, Artificial sequence
  Synthetic oligonucleotide
tgtatgctggacaccg

SEQ ID NO: 928 - DNA, 16 bp, Artificial sequence
  Synthetic oligonucleotide
gtgtatgctggacacc

SEQ ID NO: 929 - DNA, 16 bp, Artificial sequence
  Synthetic oligonucleotide
ggtgtatgctggacac

SEQ ID NO: 930 - DNA, 16 bp, Artificial sequence
  Synthetic oligonucleotide
cgggaacaggaatcag

SEQ ID NO: 931 - DNA, 16 bp, Artificial sequence
  Synthetic oligonucleotide
acgggaacaggaatca

SEQ ID NO: 932 - DNA, 16 bp, Artificial sequence
  Synthetic oligonucleotide
ccccacgggaacagga

SEQ ID NO: 933 - DNA, 16 bp, Artificial sequence
  Synthetic oligonucleotide
cgagaaggaggctgct

SEQ ID NO: 934 - DNA, 16 bp, Artificial sequence
  Synthetic oligonucleotide
ccgagaaggaggctgc

SEQ ID NO: 935 - DNA, 16 bp, Artificial sequence
  Synthetic oligonucleotide
gccgagaaggaggctg

SEQ ID NO: 936 - DNA, 16 bp, Artificial sequence
  Synthetic oligonucleotide
gcaaacacgctctggg

SEQ ID NO: 937 - DNA, 16 bp, Artificial sequence
  Synthetic oligonucleotide
ggcaaacacgctctgg

SEQ ID NO: 938 - DNA, 16 bp, Artificial sequence
  Synthetic oligonucleotide
tggcaaacacgctctg

SEQ ID NO: 939 - DNA, 16 bp, Artificial sequence
  Synthetic oligonucleotide
ttggcaaacacgctct

SEQ ID NO: 940 - DNA, 16 bp, Artificial sequence
  Synthetic oligonucleotide
tgttggcaaacacgct

SEQ ID NO: 941 - DNA, 16 bp, Artificial sequence
  Synthetic oligonucleotide
actgttggcaaacacg

SEQ ID NO: 942 - DNA, 16 bp, Artificial sequence
  Synthetic oligonucleotide
cactgttggcaaacac

SEQ ID NO: 943 - DNA, 16 bp, Artificial sequence
  Synthetic oligonucleotide
tcactgttggcaaaca

SEQ ID NO: 944 - DNA, 16 bp, Artificial sequence
  Synthetic oligonucleotide
gtcactgttggcaaac

SEQ ID NO: 945 - DNA, 16 bp, Artificial sequence
  Synthetic oligonucleotide
ggtcactgttggcaaa

SEQ ID NO: 946 - DNA, 16 bp, Artificial sequence
  Synthetic oligonucleotide
aggtcactgttggcaa

SEQ ID NO: 947 - DNA, 16 bp, Artificial sequence
  Synthetic oligonucleotide
agaggtcactgttggc

SEQ ID NO: 948 - DNA, 16 bp, Artificial sequence
  Synthetic oligonucleotide
aagaggtcactgttgg

SEQ ID NO: 949 - DNA, 16 bp, Artificial sequence
  Synthetic oligonucleotide
gaagaggtcactgttg

SEQ ID NO: 950 - DNA, 16 bp, Artificial sequence
  Synthetic oligonucleotide
gggaagaggtcactgt

SEQ ID NO: 951 - DNA, 16 bp, Artificial sequence
  Synthetic oligonucleotide
cgagatgggatctgag

SEQ ID NO: 952 - DNA, 16 bp, Artificial sequence
  Synthetic oligonucleotide
ccgagatgggatctga

SEQ ID NO: 953 - DNA, 16 bp, Artificial sequence
  Synthetic oligonucleotide
gccgagatgggatctg

SEQ ID NO: 954 - DNA, 16 bp, Artificial sequence
  Synthetic oligonucleotide
actggccgagatggga

SEQ ID NO: 955 - DNA, 16 bp, Artificial sequence
  Synthetic oligonucleotide
aactggccgagatggg

SEQ ID NO: 956 - DNA, 16 bp, Artificial sequence
  Synthetic oligonucleotide
cgaactggccgagatg

SEQ ID NO: 957 - DNA, 16 bp, Artificial sequence
  Synthetic oligonucleotide
ccgaactggccgagat

SEQ ID NO: 958 - DNA, 16 bp, Artificial sequence
  Synthetic oligonucleotide
atccgaactggccgag

SEQ ID NO: 959 - DNA, 16 bp, Artificial sequence
  Synthetic oligonucleotide
gatccgaactggccga

SEQ ID NO: 960 - DNA, 16 bp, Artificial sequence
  Synthetic oligonucleotide
gccggctgggcgcagc

SEQ ID NO: 961 - DNA, 16 bp, Artificial sequence
  Synthetic oligonucleotide
taatggtgggccggct

SEQ ID NO: 962 - DNA, 16 bp, Artificial sequence
  Synthetic oligonucleotide
gataatggtgggccgg

SEQ ID NO: 963 - DNA, 16 bp, Artificial sequence
  Synthetic oligonucleotide
ggataatggtgggccg

SEQ ID NO: 964 - DNA, 16 bp, Artificial sequence
  Synthetic oligonucleotide
cggataatggtgggcc

SEQ ID NO: 965 - DNA, 16 bp, Artificial sequence
  Synthetic oligonucleotide
ctcggctgggcggata

SEQ ID NO: 966 - DNA, 16 bp, Artificial sequence
  Synthetic oligonucleotide
cagggatggctcggct

SEQ ID NO: 967 - DNA, 16 bp, Artificial sequence
  Synthetic oligonucleotide
tcgagcagggatggct

SEQ ID NO: 968 - DNA, 16 bp, Artificial sequence
  Synthetic oligonucleotide
gtcgagcagggatggc

SEQ ID NO: 969 - DNA, 16 bp, Artificial sequence
  Synthetic oligonucleotide
gcctagtcgagcaggg

SEQ ID NO: 970 - DNA, 16 bp, Artificial sequence
  Synthetic oligonucleotide
cgagagcacgcccccc

SEQ ID NO: 971 - DNA, 16 bp, Artificial sequence
  Synthetic oligonucleotide
ccccgagagcacgccc

SEQ ID NO: 972 - DNA, 16 bp, Artificial sequence
  Synthetic oligonucleotide
actgaagctcctgcgc

SEQ ID NO: 973 - DNA, 16 bp, Artificial sequence
  Synthetic oligonucleotide
gcggagggccccagac

SEQ ID NO: 974 - DNA, 16 bp, Artificial sequence
  Synthetic oligonucleotide
gttaaggaagaggcca

SEQ ID NO: 975 - DNA, 16 bp, Artificial sequence
  Synthetic oligonucleotide
tgcggtgtccagccag

SEQ ID NO: 976 - DNA, 16 bp, Artificial sequence
  Synthetic oligonucleotide
agtgcggtgtccagcc

SEQ ID NO: 977 - DNA, 16 bp, Artificial sequence
  Synthetic oligonucleotide
cagtgcggtgtccagc

SEQ ID NO: 978 - DNA, 16 bp, Artificial sequence
  Synthetic oligonucleotide
gcagtgcggtgtccag

SEQ ID NO: 979 - DNA, 16 bp, Artificial sequence
  Synthetic oligonucleotide
gcgcagtgcggtgtcc

SEQ ID NO: 980 - DNA, 16 bp, Artificial sequence
  Synthetic oligonucleotide
tgcgcagtgcggtgtc

SEQ ID NO: 981 - DNA, 16 bp, Artificial sequence
  Synthetic oligonucleotide
cctttgcgcagtgcgg

SEQ ID NO: 982 - DNA, 16 bp, Artificial sequence
  Synthetic oligonucleotide
ccctttgcgcagtgcg

SEQ ID NO: 983 - DNA, 16 bp, Artificial sequence
  Synthetic oligonucleotide
gcccctttgcgcagtg

SEQ ID NO: 984 - DNA, 16 bp, Artificial sequence
  Synthetic oligonucleotide
ggcccctttgcgcagt

SEQ ID NO: 985 - DNA, 16 bp, Artificial sequence
  Synthetic oligonucleotide
gtgcaacaccccagcg

SEQ ID NO: 986 - DNA, 16 bp, Artificial sequence
  Synthetic oligonucleotide
ccaaagtgcaacaccc

SEQ ID NO: 987 - DNA, 16 bp, Artificial sequence
  Synthetic oligonucleotide
cccaaagtgcaacacc

SEQ ID NO: 988 - DNA, 16 bp, Artificial sequence
  Synthetic oligonucleotide
tgccaccctgagactc

SEQ ID NO: 989 - DNA, 16 bp, Artificial sequence
  Synthetic oligonucleotide
tcaagggttctggtcc

SEQ ID NO: 990 - DNA, 16 bp, Artificial sequence
  Synthetic oligonucleotide
gtcaagggttctggtc

SEQ ID NO: 991 - DNA, 16 bp, Artificial sequence
  Synthetic oligonucleotide
gtgtcaagggttctgg

SEQ ID NO: 992 - DNA, 16 bp, Artificial sequence
  Synthetic oligonucleotide
tggtgtcaagggttct

SEQ ID NO: 993 - DNA, 16 bp, Artificial sequence
  Synthetic oligonucleotide
atggtgtcaagggttc

SEQ ID NO: 994 - DNA, 16 bp, Artificial sequence
  Synthetic oligonucleotide
gatggtgtcaagggtt

SEQ ID NO: 995 - DNA, 16 bp, Artificial sequence
  Synthetic oligonucleotide
aggatggtgtcaaggg

SEQ ID NO: 996 - DNA, 16 bp, Artificial sequence
  Synthetic oligonucleotide
caggatggtgtcaagg

SEQ ID NO: 997 - DNA, 16 bp, Artificial sequence
  Synthetic oligonucleotide
tcaggatggtgtcaag

SEQ ID NO: 998 - DNA, 16 bp, Artificial sequence
  Synthetic oligonucleotide
attcaggatggtgtca

SEQ ID NO: 999 - DNA, 16 bp, Artificial sequence
  Synthetic oligonucleotide
tcattcaggatggtgt

SEQ ID NO: 1000 - DNA, 16 bp, Artificial sequence
  Synthetic oligonucleotide
cctcattcaggatggt

SEQ ID NO: 1001 - DNA, 16 bp, Artificial sequence
  Synthetic oligonucleotide
gtagagtcccccccag

SEQ ID NO: 1002 - DNA, 16 bp, Artificial sequence
  Synthetic oligonucleotide
tggtagagtccccccc

SEQ ID NO: 1003 - DNA, 16 bp, Artificial sequence
  Synthetic oligonucleotide
ttggtagagtcccccc

SEQ ID NO: 1004 - DNA, 16 bp, Artificial sequence
  Synthetic oligonucleotide
cttggtagagtccccc

SEQ ID NO: 1005 - DNA, 16 bp, Artificial sequence
  Synthetic oligonucleotide
accttggtagagtccc

SEQ ID NO: 1006 - DNA, 16 bp, Artificial sequence
  Synthetic oligonucleotide
gaccttggtagagtcc

SEQ ID NO: 1007 - DNA, 16 bp, Artificial sequence
  Synthetic oligonucleotide
gaagaccttggtagag

SEQ ID NO: 1008 - DNA, 16 bp, Artificial sequence
  Synthetic oligonucleotide
aagaagaccttggtag

SEQ ID NO: 1009 - DNA, 16 bp, Artificial sequence
  Synthetic oligonucleotide
caagaagaccttggta

SEQ ID NO: 1010 - DNA, 16 bp, Artificial sequence
  Synthetic oligonucleotide
ccaagaagaccttggt

SEQ ID NO: 1011 - DNA, 16 bp, Artificial sequence
  Synthetic oligonucleotide
cccaagaagaccttgg

SEQ ID NO: 1012 - DNA, 16 bp, Artificial sequence
  Synthetic oligonucleotide
gcccaagaagaccttg

SEQ ID NO: 1013 - DNA, 16 bp, Artificial sequence
  Synthetic oligonucleotide
ctacatgggctttccc

SEQ ID NO: 1014 - DNA, 16 bp, Artificial sequence
  Synthetic oligonucleotide
ccctacatgggctttc

SEQ ID NO: 1015 - DNA, 16 bp, Artificial sequence
  Synthetic oligonucleotide
tatagaaggcctgccc

SEQ ID NO: 1016 - DNA, 16 bp, Artificial sequence
  Synthetic oligonucleotide
cttatagaaggcctgc

SEQ ID NO: 1017 - DNA, 16 bp, Artificial sequence
  Synthetic oligonucleotide
acttatagaaggcctg

SEQ ID NO: 1018 - DNA, 16 bp, Artificial sequence
  Synthetic oligonucleotide
cacttatagaaggcct

SEQ ID NO: 1019 - DNA, 16 bp, Artificial sequence
  Synthetic oligonucleotide
cgcacttatagaaggc

SEQ ID NO: 1020 - DNA, 16 bp, Artificial sequence
  Synthetic oligonucleotide
ccgcacttatagaagg

SEQ ID NO: 1021 - DNA, 16 bp, Artificial sequence
  Synthetic oligonucleotide
ccctgcaccccagcaa

SEQ ID NO: 1022 - DNA, 16 bp, Artificial sequence
  Synthetic oligonucleotide
atacccctgcacccca

SEQ ID NO: 1023 - DNA, 16 bp, Artificial sequence
  Synthetic oligonucleotide
atatacccctgcaccc

SEQ ID NO: 1024 - DNA, 16 bp, Artificial sequence
  Synthetic oligonucleotide
gatatacccctgcacc

SEQ ID NO: 1025 - DNA, 16 bp, Artificial sequence
  Synthetic oligonucleotide
tgatatacccctgcac

SEQ ID NO: 1026 - DNA, 16 bp, Artificial sequence
  Synthetic oligonucleotide
ttgatatacccctgca

SEQ ID NO: 1027 - DNA, 16 bp, Artificial sequence
  Synthetic oligonucleotide
gttgatatacccctgc

SEQ ID NO: 1028 - DNA, 16 bp, Artificial sequence
  Synthetic oligonucleotide
gggaagttgatatacc

SEQ ID NO: 1029 - DNA, 16 bp, Artificial sequence
  Synthetic oligonucleotide
tgggaagttgatatac

SEQ ID NO: 1030 - DNA, 16 bp, Artificial sequence
  Synthetic oligonucleotide
aatgggaagttgatat

SEQ ID NO: 1031 - DNA, 16 bp, Artificial sequence
  Synthetic oligonucleotide
taatgggaagttgata

SEQ ID NO: 1032 - DNA, 16 bp, Artificial sequence
  Synthetic oligonucleotide
ctaatgggaagttgat

SEQ ID NO: 1033 - DNA, 16 bp, Artificial sequence
  Synthetic oligonucleotide
tgctaatgggaagttg

SEQ ID NO: 1034 - DNA, 16 bp, Artificial sequence
  Synthetic oligonucleotide
ctgctaatgggaagtt

SEQ ID NO: 1035 - DNA, 16 bp, Artificial sequence
  Synthetic oligonucleotide
tcctgctaatgggaag

SEQ ID NO: 1036 - DNA, 16 bp, Artificial sequence
  Synthetic oligonucleotide
ctcctgctaatgggaa

SEQ ID NO: 1037 - DNA, 16 bp, Artificial sequence
  Synthetic oligonucleotide
gagctcctgctaatgg

SEQ ID NO: 1038 - DNA, 16 bp, Artificial sequence
  Synthetic oligonucleotide
ggccaggcttgccgct

SEQ ID NO: 1039 - DNA, 16 bp, Artificial sequence
  Synthetic oligonucleotide
taccgagcccactggg

SEQ ID NO: 1040 - DNA, 16 bp, Artificial sequence
  Synthetic oligonucleotide
cactaccgagcccact

SEQ ID NO: 1041 - DNA, 16 bp, Artificial sequence
  Synthetic oligonucleotide
ggcactaccgagccca

SEQ ID NO: 1042 - DNA, 16 bp, Artificial sequence
  Synthetic oligonucleotide
ctgggcactaccgagc

SEQ ID NO: 1043 - DNA, 16 bp, Artificial sequence
  Synthetic oligonucleotide
gccagctgggcactac

SEQ ID NO: 1044 - DNA, 16 bp, Artificial sequence
  Synthetic oligonucleotide
tgccagctgggcacta

SEQ ID NO: 1045 - DNA, 16 bp, Artificial sequence
  Synthetic oligonucleotide
tacacctcaggcctgc

SEQ ID NO: 1046 - DNA, 16 bp, Artificial sequence
  Synthetic oligonucleotide
gtacacctcaggcctg

SEQ ID NO: 1047 - DNA, 16 bp, Artificial sequence
  Synthetic oligonucleotide
atgtacacctcaggcc

SEQ ID NO: 1048 - DNA, 16 bp, Artificial sequence
  Synthetic oligonucleotide
tatgtacacctcaggc

SEQ ID NO: 1049 - DNA, 16 bp, Artificial sequence
  Synthetic oligonucleotide
actatgtacacctcag

SEQ ID NO: 1050 - DNA, 16 bp, Artificial sequence
  Synthetic oligonucleotide
gactatgtacacctca

SEQ ID NO: 1051 - DNA, 16 bp, Artificial sequence
  Synthetic oligonucleotide
aggactatgtacacct

SEQ ID NO: 1052 - DNA, 16 bp, Artificial sequence
  Synthetic oligonucleotide
aaggactatgtacacc

SEQ ID NO: 1053 - DNA, 16 bp, Artificial sequence
  Synthetic oligonucleotide
ggaaggactatgtaca

SEQ ID NO: 1054 - DNA, 16 bp, Artificial sequence
  Synthetic oligonucleotide
gggaaggactatgtac

SEQ ID NO: 1055 - DNA, 16 bp, Artificial sequence
  Synthetic oligonucleotide
cgggaaggactatgta

SEQ ID NO: 1056 - DNA, 16 bp, Artificial sequence
  Synthetic oligonucleotide
ccgggaaggactatgt

SEQ ID NO: 1057 - DNA, 16 bp, Artificial sequence
  Synthetic oligonucleotide
gccgggaaggactatg

SEQ ID NO: 1058 - DNA, 16 bp, Artificial sequence
  Synthetic oligonucleotide
atatggccgggaagga

SEQ ID NO: 1059 - DNA, 16 bp, Artificial sequence
  Synthetic oligonucleotide
taatatggccgggaag

SEQ ID NO: 1060 - DNA, 16 bp, Artificial sequence
  Synthetic oligonucleotide
ttaatatggccgggaa

SEQ ID NO: 1061 - DNA, 16 bp, Artificial sequence
  Synthetic oligonucleotide
gttaatatggccggga

SEQ ID NO: 1062 - DNA, 16 bp, Artificial sequence
  Synthetic oligonucleotide
tggttaatatggccgg

SEQ ID NO: 1063 - DNA, 16 bp, Artificial sequence
  Synthetic oligonucleotide
gtggttaatatggccg

SEQ ID NO: 1064 - DNA, 16 bp, Artificial sequence
  Synthetic oligonucleotide
tgtggttaatatggcc

SEQ ID NO: 1065 - DNA, 16 bp, Artificial sequence
  Synthetic oligonucleotide
tgtgtggttaatatgg

SEQ ID NO: 1066 - DNA, 16 bp, Artificial sequence
  Synthetic oligonucleotide
ctgtgtggttaatatg

SEQ ID NO: 1067 - DNA, 16 bp, Artificial sequence
  Synthetic oligonucleotide
gctgtgtggttaatat

SEQ ID NO: 1068 - DNA, 16 bp, Artificial sequence
  Synthetic oligonucleotide
aggctgtgtggttaat

SEQ ID NO: 1069 - DNA, 16 bp, Artificial sequence
  Synthetic oligonucleotide
ggcctagcaaaggcac

SEQ ID NO: 1070 - DNA, 16 bp, Artificial sequence
  Synthetic oligonucleotide
gccaacggctccgggc

SEQ ID NO: 1071 - DNA, 16 bp, Artificial sequence
  Synthetic oligonucleotide
gcccgggccaacggct

SEQ ID NO: 1072 - DNA, 16 bp, Artificial sequence
  Synthetic oligonucleotide
caaggccggcccgggc

SEQ ID NO: 1073 - DNA, 16 bp, Artificial sequence
  Synthetic oligonucleotide
ggcaaggccggcccgg

SEQ ID NO: 1074 - DNA, 16 bp, Artificial sequence
  Synthetic oligonucleotide
aatagggcaaggccgg

SEQ ID NO: 1075 - DNA, 16 bp, Artificial sequence
  Synthetic oligonucleotide
gaatagggcaaggccg

SEQ ID NO: 1076 - DNA, 16 bp, Artificial sequence
  Synthetic oligonucleotide
ggaatagggcaaggcc

SEQ ID NO: 1077 - DNA, 16 bp, Artificial sequence
  Synthetic oligonucleotide
gaggaatagggcaagg

SEQ ID NO: 1078 - DNA, 16 bp, Artificial sequence
  Synthetic oligonucleotide
agaggaatagggcaag

SEQ ID NO: 1079 - DNA, 16 bp, Artificial sequence
  Synthetic oligonucleotide
gagaggaatagggcaa

SEQ ID NO: 1080 - DNA, 16 bp, Artificial sequence
  Synthetic oligonucleotide
aggagaggaatagggc

SEQ ID NO: 1081 - DNA, 16 bp, Artificial sequence
  Synthetic oligonucleotide
acatagcccaagccca

SEQ ID NO: 1082 - DNA, 16 bp, Artificial sequence
  Synthetic oligonucleotide
cacatagcccaagccc

SEQ ID NO: 1083 - DNA, 16 bp, Artificial sequence
  Synthetic oligonucleotide
ccacatagcccaagcc

SEQ ID NO: 1084 - DNA, 16 bp, Artificial sequence
  Synthetic oligonucleotide
acccacatagcccaag

SEQ ID NO: 1085 - DNA, 16 bp, Artificial sequence
  Synthetic oligonucleotide
acccatcagggaggca

SEQ ID NO: 1086 - DNA, 16 bp, Artificial sequence
  Synthetic oligonucleotide
cagagagaggccgccc

SEQ ID NO: 1087 - DNA, 16 bp, Artificial sequence
  Synthetic oligonucleotide
cctcagagagaggccg

SEQ ID NO: 1088 - DNA, 16 bp, Artificial sequence
  Synthetic oligonucleotide
agcgaggagtgggtga

SEQ ID NO: 1089 - DNA, 16 bp, Artificial sequence
  Synthetic oligonucleotide
ctgagcgaggagtggg

SEQ ID NO: 1090 - DNA, 16 bp, Artificial sequence
  Synthetic oligonucleotide
actgagcgaggagtgg

SEQ ID NO: 1091 - DNA, 16 bp, Artificial sequence
  Synthetic oligonucleotide
aaactgagcgaggagt

SEQ ID NO: 1092 - DNA, 16 bp, Artificial sequence
  Synthetic oligonucleotide
caaactgagcgaggag

SEQ ID NO: 1093 - DNA, 16 bp, Artificial sequence
  Synthetic oligonucleotide
gtcaaactgagcgagg

SEQ ID NO: 1094 - DNA, 16 bp, Artificial sequence
  Synthetic oligonucleotide
ggtcaaactgagcgag

SEQ ID NO: 1095 - DNA, 16 bp, Artificial sequence
  Synthetic oligonucleotide
tggtcaaactgagcga

SEQ ID NO: 1096 - DNA, 16 bp, Artificial sequence
  Synthetic oligonucleotide
agtggtcaaactgagc

SEQ ID NO: 1097 - DNA, 16 bp, Artificial sequence
  Synthetic oligonucleotide
cagtggtcaaactgag

SEQ ID NO: 1098 - DNA, 16 bp, Artificial sequence
  Synthetic oligonucleotide
acagtggtcaaactga

SEQ ID NO: 1099 - DNA, 16 bp, Artificial sequence
  Synthetic oligonucleotide
tacagtggtcaaactg

SEQ ID NO: 1100 - DNA, 16 bp, Artificial sequence
  Synthetic oligonucleotide
ttacagtggtcaaact

SEQ ID NO: 1101 - DNA, 16 bp, Artificial sequence
  Synthetic oligonucleotide
acttacagtggtcaaa

SEQ ID NO: 1102 - DNA, 16 bp, Artificial sequence
  Synthetic oligonucleotide
cacttacagtggtcaa

SEQ ID NO: 1103 - DNA, 16 bp, Artificial sequence
  Synthetic oligonucleotide
gcacttacagtggtca

SEQ ID NO: 1104 - DNA, 16 bp, Artificial sequence
  Synthetic oligonucleotide
ggcacttacagtggtc

SEQ ID NO: 1105 - DNA, 16 bp, Artificial sequence
  Synthetic oligonucleotide
aggcacttacagtggt

SEQ ID NO: 1106 - DNA, 16 bp, Artificial sequence
  Synthetic oligonucleotide
gtgcaggcacttacag

SEQ ID NO: 1107 - DNA, 16 bp, Artificial sequence
  Synthetic oligonucleotide
agagtgcaggcactta

SEQ ID NO: 1108 - DNA, 16 bp, Artificial sequence
  Synthetic oligonucleotide
acagagtgcaggcact

SEQ ID NO: 1109 - DNA, 16 bp, Artificial sequence
  Synthetic oligonucleotide
tacagagtgcaggcac

SEQ ID NO: 1110 - DNA, 16 bp, Artificial sequence
  Synthetic oligonucleotide
atacagagtgcaggca

SEQ ID NO: 1111 - DNA, 16 bp, Artificial sequence
  Synthetic oligonucleotide
gaatacagagtgcagg

SEQ ID NO: 1112 - DNA, 16 bp, Artificial sequence
  Synthetic oligonucleotide
agaatacagagtgcag

SEQ ID NO: 1113 - DNA, 16 bp, Artificial sequence
  Synthetic oligonucleotide
tagaatacagagtgca

SEQ ID NO: 1114 - DNA, 16 bp, Artificial sequence
  Synthetic oligonucleotide
aatagaatacagagtg

SEQ ID NO: 1115 - DNA, 16 bp, Artificial sequence
  Synthetic oligonucleotide
gctcaccggcccacga

SEQ ID NO: 1116 - DNA, 16 bp, Artificial sequence
  Synthetic oligonucleotide
cgcgggcacgcaagcg

SEQ ID NO: 1117 - DNA, 16 bp, Artificial sequence
  Synthetic oligonucleotide
cgtgacaccgcccctg

SEQ ID NO: 1118 - DNA, 16 bp, Artificial sequence
  Synthetic oligonucleotide
atctaccccagaccca

SEQ ID NO: 1119 - DNA, 16 bp, Artificial sequence
  Synthetic oligonucleotide
cagaagagggatctac

SEQ ID NO: 1120 - DNA, 16 bp, Artificial sequence
  Synthetic oligonucleotide
caatagatatctagat

SEQ ID NO: 1121 - DNA, 16 bp, Artificial sequence
  Synthetic oligonucleotide
cccaatagatatctag

SEQ ID NO: 1122 - DNA, 16 bp, Artificial sequence
  Synthetic oligonucleotide
agatacaagaacaagc

SEQ ID NO: 1123 - DNA, 16 bp, Artificial sequence
  Synthetic oligonucleotide
agctagccagacagca

SEQ ID NO: 1124 - DNA, 16 bp, Artificial sequence
  Synthetic oligonucleotide
caacagagggactgct

SEQ ID NO: 1125 - DNA, 16 bp, Artificial sequence
  Synthetic oligonucleotide
acagtagaggccagct

SEQ ID NO: 1126 - DNA, 16 bp, Artificial sequence
  Synthetic oligonucleotide
cggaagagaggagcca

SEQ ID NO: 1127 - DNA, 16 bp, Artificial sequence
  Synthetic oligonucleotide
tcacacggaagagagg

SEQ ID NO: 1128 - DNA, 16 bp, Artificial sequence
  Synthetic oligonucleotide
gaagaattcacacgga

SEQ ID NO: 1129 - DNA, 16 bp, Artificial sequence
  Synthetic oligonucleotide
gtccaaacctcctcct

SEQ ID NO: 1130 - DNA, 16 bp, Artificial sequence
  Synthetic oligonucleotide
tcctgaagtaaggtac

SEQ ID NO: 1131 - DNA, 16 bp, Artificial sequence
  Synthetic oligonucleotide
tcggaaaggaatcctg

SEQ ID NO: 1132 - DNA, 16 bp, Artificial sequence
  Synthetic oligonucleotide
aatttgtaggctgtag

SEQ ID NO: 1133 - DNA, 16 bp, Artificial sequence
  Synthetic oligonucleotide
tccaaaggagggcccc

SEQ ID NO: 1134 - DNA, 16 bp, Artificial sequence
  Synthetic oligonucleotide
caccgcggcttctcaa

SEQ ID NO: 1135 - DNA, 16 bp, Artificial sequence
  Synthetic oligonucleotide
gagaagtggccgccca

SEQ ID NO: 1136 - DNA, 16 bp, Artificial sequence
  Synthetic oligonucleotide
ccacaaatgagtagtt

SEQ ID NO: 1137 - DNA, 16 bp, Artificial sequence
  Synthetic oligonucleotide
cattatcccttgacaa

SEQ ID NO: 1138 - DNA, 16 bp, Artificial sequence
  Synthetic oligonucleotide
atcaagaagggacatt

SEQ ID NO: 1139 - DNA, 16 bp, Artificial sequence
  Synthetic oligonucleotide
ggtgatcacagtccct

SEQ ID NO: 1140 - DNA, 16 bp, Artificial sequence
  Synthetic oligonucleotide
agagacaaggtagcaa

SEQ ID NO: 1141 - DNA, 16 bp, Artificial sequence
  Synthetic oligonucleotide
aggcaatgagctagag

SEQ ID NO: 1142 - DNA, 16 bp, Artificial sequence
  Synthetic oligonucleotide
gaagatggtcactcaa

SEQ ID NO: 1143 - DNA, 16 bp, Artificial sequence
  Synthetic oligonucleotide
aggaagatggtcactc

SEQ ID NO: 1144 - DNA, 16 bp, Artificial sequence
  Synthetic oligonucleotide
gtcaaccaagacttag

SEQ ID NO: 1145 - DNA, 16 bp, Artificial sequence
  Synthetic oligonucleotide
tagaatggcatcttgt

SEQ ID NO: 1146 - DNA, 16 bp, Artificial sequence
  Synthetic oligonucleotide
ccggatctggttctgt

SEQ ID NO: 1147 - DNA, 16 bp, Artificial sequence
  Synthetic oligonucleotide
aaccagccagataaac

SEQ ID NO: 1148 - DNA, 16 bp, Artificial sequence
  Synthetic oligonucleotide
gcttaagtgtgtaacg

SEQ ID NO: 1149 - DNA, 16 bp, Artificial sequence
  Synthetic oligonucleotide
ggcttaagtgtgtaac

SEQ ID NO: 1150 - DNA, 16 bp, Artificial sequence
  Synthetic oligonucleotide
gattatagcaatgcct

SEQ ID NO: 1151 - DNA, 16 bp, Artificial sequence
  Synthetic oligonucleotide
gctcagctatctgagc

SEQ ID NO: 1152 - DNA, 16 bp, Artificial sequence
  Synthetic oligonucleotide
ccagacaccatggtag

SEQ ID NO: 1153 - DNA, 16 bp, Artificial sequence
  Synthetic oligonucleotide
atataatgagcaactc

SEQ ID NO: 1154 - DNA, 16 bp, Artificial sequence
  Synthetic oligonucleotide
gtgagactcggtgtaa

SEQ ID NO: 1155 - DNA, 16 bp, Artificial sequence
  Synthetic oligonucleotide
gtggtaacgcgcgcct

SEQ ID NO: 1156 - DNA, 16 bp, Artificial sequence
  Synthetic oligonucleotide
aatactcttaacgagg

SEQ ID NO: 1157 - DNA, 16 bp, Artificial sequence
  Synthetic oligonucleotide
accttatctcttacac

SEQ ID NO: 1158 - DNA, 16 bp, Artificial sequence
  Synthetic oligonucleotide
tccaggctcggcgcaa

SEQ ID NO: 1159 - DNA, 16 bp, Artificial sequence
  Synthetic oligonucleotide
agctatagggctgaac

SEQ ID NO: 1160 - DNA, 16 bp, Artificial sequence
  Synthetic oligonucleotide
cgcaggtaaaacaaaa

SEQ ID NO: 1161 - DNA, 16 bp, Artificial sequence
  Synthetic oligonucleotide
acgcaggtaaaacaaa

SEQ ID NO: 1162 - DNA, 16 bp, Artificial sequence
  Synthetic oligonucleotide
agctacgcaggtaaaa

SEQ ID NO: 1163 - DNA, 16 bp, Artificial sequence
  Synthetic oligonucleotide
aaaagctacgcaggta

SEQ ID NO: 1164 - DNA, 16 bp, Artificial sequence
  Synthetic oligonucleotide
ccggatattgactgga

SEQ ID NO: 1165 - DNA, 16 bp, Artificial sequence
  Synthetic oligonucleotide
tgtcttagagccacaa

SEQ ID NO: 1166 - DNA, 16 bp, Artificial sequence
  Synthetic oligonucleotide
ctctatagatctgagt

SEQ ID NO: 1167 - DNA, 16 bp, Artificial sequence
  Synthetic oligonucleotide
gacaactcagaactct

SEQ ID NO: 1168 - DNA, 16 bp, Artificial sequence
  Synthetic oligonucleotide
taccaccctcagctta

SEQ ID NO: 1169 - DNA, 16 bp, Artificial sequence
  Synthetic oligonucleotide
cgccaggtgaaactga

SEQ ID NO: 1170 - DNA, 16 bp, Artificial sequence
  Synthetic oligonucleotide
ccacaagggacaaagg

SEQ ID NO: 1171 - DNA, 16 bp, Artificial sequence
  Synthetic oligonucleotide
tcgaagccattactgc

SEQ ID NO: 1172 - DNA, 16 bp, Artificial sequence
  Synthetic oligonucleotide
tgctagggagtagtgg

SEQ ID NO: 1173 - DNA, 16 bp, Artificial sequence
  Synthetic oligonucleotide
gcaaaatgatctaggc

SEQ ID NO: 1174 - DNA, 16 bp, Artificial sequence
  Synthetic oligonucleotide
ccgcagacaagccagg

SEQ ID NO: 1175 - DNA, 16 bp, Artificial sequence
  Synthetic oligonucleotide
ccaaagttctatctgc

SEQ ID NO: 1176 - DNA, 16 bp, Artificial sequence
  Synthetic oligonucleotide
tgacaagggtcaagag

SEQ ID NO: 1177 - DNA, 16 bp, Artificial sequence
  Synthetic oligonucleotide
ctaaatgacaagggtc

SEQ ID NO: 1178 - DNA, 16 bp, Artificial sequence
  Synthetic oligonucleotide
ggctaaatgacaaggg

SEQ ID NO: 1179 - DNA, 16 bp, Artificial sequence
  Synthetic oligonucleotide
gtataagaccctatct

SEQ ID NO: 1180 - DNA, 16 bp, Artificial sequence
  Synthetic oligonucleotide
atttgaggcgaggagg

SEQ ID NO: 1181 - DNA, 16 bp, Artificial sequence
  Synthetic oligonucleotide
ttttaaagaagacggg

SEQ ID NO: 1182 - DNA, 16 bp, Artificial sequence
  Synthetic oligonucleotide
tgctattataactcct

SEQ ID NO: 1183 - DNA, 16 bp, Artificial sequence
  Synthetic oligonucleotide
gaacaacacctaatgt

SEQ ID NO: 1184 - DNA, 16 bp, Artificial sequence
  Synthetic oligonucleotide
gaacgaacaacaccta

SEQ ID NO: 1185 - DNA, 16 bp, Artificial sequence
  Synthetic oligonucleotide
aatgaacgaacaacac

SEQ ID NO: 1186 - DNA, 16 bp, Artificial sequence
  Synthetic oligonucleotide
agtaaaagtactcagg

SEQ ID NO: 1187 - DNA, 16 bp, Artificial sequence
  Synthetic oligonucleotide
tggtaacttgctcagg

SEQ ID NO: 1188 - DNA, 16 bp, Artificial sequence
  Synthetic oligonucleotide
gctgaaaggccagctc

SEQ ID NO: 1189 - DNA, 16 bp, Artificial sequence
  Synthetic oligonucleotide
ctacaggtgtcaccat

SEQ ID NO: 1190 - DNA, 16 bp, Artificial sequence
  Synthetic oligonucleotide
acttatcgcctttttt

SEQ ID NO: 1191 - DNA, 16 bp, Artificial sequence
  Synthetic oligonucleotide
ctccactggcctgcta

SEQ ID NO: 1192 - DNA, 16 bp, Artificial sequence
  Synthetic oligonucleotide
agggacagcagtagcg

SEQ ID NO: 1193 - DNA, 16 bp, Artificial sequence
  Synthetic oligonucleotide
agaaaaatggcacggg

SEQ ID NO: 1194 - DNA, 16 bp, Artificial sequence
  Synthetic oligonucleotide
taaaaacgcagctgga

SEQ ID NO: 1195 - DNA, 16 bp, Artificial sequence
  Synthetic oligonucleotide
tgcactggtgcagcac

SEQ ID NO: 1196 - DNA, 16 bp, Artificial sequence
  Synthetic oligonucleotide
ggctctaaactaataa

SEQ ID NO: 1197 - DNA, 16 bp, Artificial sequence
  Synthetic oligonucleotide
tcgggattcactatgt

SEQ ID NO: 1198 - DNA, 16 bp, Artificial sequence
  Synthetic oligonucleotide
cgcttactgcaagttc

SEQ ID NO: 1199 - DNA, 16 bp, Artificial sequence
  Synthetic oligonucleotide
cctaaccgagccttgc

SEQ ID NO: 1200 - DNA, 16 bp, Artificial sequence
  Synthetic oligonucleotide
acaacaatttgctacg

SEQ ID NO: 1201 - DNA, 16 bp, Artificial sequence
  Synthetic oligonucleotide
tcacaacaatttgcta

SEQ ID NO: 1202 - DNA, 16 bp, Artificial sequence
  Synthetic oligonucleotide
tgacaccaaactgagc

SEQ ID NO: 1203 - DNA, 16 bp, Artificial sequence
  Synthetic oligonucleotide
aaagaaactaaggccg

SEQ ID NO: 1204 - DNA, 16 bp, Artificial sequence
  Synthetic oligonucleotide
taatgatgagttcctt

SEQ ID NO: 1205 - DNA, 16 bp, Artificial sequence
  Synthetic oligonucleotide
caacagagtaatgatg

SEQ ID NO: 1206 - DNA, 16 bp, Artificial sequence
  Synthetic oligonucleotide
cgatatttcaggatct

SEQ ID NO: 1207 - DNA, 16 bp, Artificial sequence
  Synthetic oligonucleotide
ctcatcaccgtacaca

SEQ ID NO: 1208 - DNA, 16 bp, Artificial sequence
  Synthetic oligonucleotide
ccctatcattggtttt

SEQ ID NO: 1209 - DNA, 16 bp, Artificial sequence
  Synthetic oligonucleotide
taacaggtcttgtgca

SEQ ID NO: 1210 - DNA, 16 bp, Artificial sequence
  Synthetic oligonucleotide
acgattcacatgtggg

SEQ ID NO: 1211 - DNA, 16 bp, Artificial sequence
  Synthetic oligonucleotide
aacctaatccccaaac

SEQ ID NO: 1212 - DNA, 16 bp, Artificial sequence
  Synthetic oligonucleotide
agcacttggacagcct

SEQ ID NO: 1213 - DNA, 16 bp, Artificial sequence
  Synthetic oligonucleotide
gaaaaagcacttggac

SEQ ID NO: 1214 - DNA, 16 bp, Artificial sequence
  Synthetic oligonucleotide
caataagtaactctga

SEQ ID NO: 1215 - DNA, 16 bp, Artificial sequence
  Synthetic oligonucleotide
atctacaactgtcccc

SEQ ID NO: 1216 - DNA, 16 bp, Artificial sequence
  Synthetic oligonucleotide
aataatgagaccccac

SEQ ID NO: 1217 - DNA, 16 bp, Artificial sequence
  Synthetic oligonucleotide
taaatctaacctaggc

SEQ ID NO: 1218 - DNA, 16 bp, Artificial sequence
  Synthetic oligonucleotide
cagaagtttggcagat

SEQ ID NO: 1219 - DNA, 16 bp, Artificial sequence
  Synthetic oligonucleotide
tcaaatcgggcagaag

SEQ ID NO: 1220 - DNA, 16 bp, Artificial sequence
  Synthetic oligonucleotide
aaattacggtttacat

SEQ ID NO: 1221 - DNA, 16 bp, Artificial sequence
  Synthetic oligonucleotide
taaattacggtttaca

SEQ ID NO: 1222 - DNA, 16 bp, Artificial sequence
  Synthetic oligonucleotide
ttgtagttggcaatcc

SEQ ID NO: 1223 - DNA, 16 bp, Artificial sequence
  Synthetic oligonucleotide
ggcttaattacagctt

SEQ ID NO: 1224 - DNA, 16 bp, Artificial sequence
  Synthetic oligonucleotide
cacaataagggcttaa

SEQ ID NO: 1225 - DNA, 16 bp, Artificial sequence
  Synthetic oligonucleotide
acacaataagggctta

SEQ ID NO: 1226 - DNA, 16 bp, Artificial sequence
  Synthetic oligonucleotide
ccctataaatatctca

SEQ ID NO: 1227 - DNA, 16 bp, Artificial sequence
  Synthetic oligonucleotide
acgcacccggaagcag

SEQ ID NO: 1228 - DNA, 16 bp, Artificial sequence
  Synthetic oligonucleotide
aaacagtcatccagct

SEQ ID NO: 1229 - DNA, 16 bp, Artificial sequence
  Synthetic oligonucleotide
tggcacacggtgattc

SEQ ID NO: 1230 - DNA, 16 bp, Artificial sequence
  Synthetic oligonucleotide
gcacatgtggcacacg

SEQ ID NO: 1231 - DNA, 16 bp, Artificial sequence
  Synthetic oligonucleotide
agggatgctaagagca

SEQ ID NO: 1232 - DNA, 16 bp, Artificial sequence
  Synthetic oligonucleotide
tataaagcagggatgc

SEQ ID NO: 1233 - DNA, 16 bp, Artificial sequence
  Synthetic oligonucleotide
ccatatgtgtggctct

SEQ ID NO: 1234 - DNA, 16 bp, Artificial sequence
  Synthetic oligonucleotide
gcatatccaaagccac

SEQ ID NO: 1235 - DNA, 16 bp, Artificial sequence
  Synthetic oligonucleotide
catttaactgttcacc

SEQ ID NO: 1236 - DNA, 16 bp, Artificial sequence
  Synthetic oligonucleotide
cgacagacaagtacca

SEQ ID NO: 1237 - DNA, 16 bp, Artificial sequence
  Synthetic oligonucleotide
gcatacagcctttttt

SEQ ID NO: 1238 - DNA, 16 bp, Artificial sequence
  Synthetic oligonucleotide
cgcatacagccttttt

SEQ ID NO: 1239 - DNA, 16 bp, Artificial sequence
  Synthetic oligonucleotide
accgcatacagccttt

SEQ ID NO: 1240 - DNA, 16 bp, Artificial sequence
  Synthetic oligonucleotide
caccgcatacagcctt

SEQ ID NO: 1241 - DNA, 16 bp, Artificial sequence
  Synthetic oligonucleotide
aaccaccgcatacagc

SEQ ID NO: 1242 - DNA, 16 bp, Artificial sequence
  Synthetic oligonucleotide
tgaaccaccgcataca

SEQ ID NO: 1243 - DNA, 16 bp, Artificial sequence
  Synthetic oligonucleotide
tgcaaccttcaagtaa

SEQ ID NO: 1244 - DNA, 16 bp, Artificial sequence
  Synthetic oligonucleotide
gcaaaccgcttctcac

SEQ ID NO: 1245 - DNA, 16 bp, Artificial sequence
  Synthetic oligonucleotide
ccccaagtcctggcgg

SEQ ID NO: 1246 - DNA, 16 bp, Artificial sequence
  Synthetic oligonucleotide
gaaaagtcggcattcc

SEQ ID NO: 1247 - DNA, 16 bp, Artificial sequence
  Synthetic oligonucleotide
tgacagtggtgctccc

SEQ ID NO: 1248 - DNA, 16 bp, Artificial sequence
  Synthetic oligonucleotide
tggcatgtggttgttg

SEQ ID NO: 1249 - DNA, 16 bp, Artificial sequence
  Synthetic oligonucleotide
aacaaatatatgcacg

SEQ ID NO: 1250 - DNA, 16 bp, Artificial sequence
  Synthetic oligonucleotide
tcgcacctcgggattc

SEQ ID NO: 1251 - DNA, 16 bp, Artificial sequence
  Synthetic oligonucleotide
gtgaaattcactccat

SEQ ID NO: 1252 - DNA, 16 bp, Artificial sequence
  Synthetic oligonucleotide
ggaagatgtccttgct

SEQ ID NO: 1253 - DNA, 16 bp, Artificial sequence
  Synthetic oligonucleotide
atagatggagcaaatc

SEQ ID NO: 1254 - DNA, 16 bp, Artificial sequence
  Synthetic oligonucleotide
ttatatagatggagca

SEQ ID NO: 1255 - DNA, 16 bp, Artificial sequence
  Synthetic oligonucleotide
acgcagatagacaccc

SEQ ID NO: 1256 - DNA, 16 bp, Artificial sequence
  Synthetic oligonucleotide
gccaacgcagatagac

SEQ ID NO: 1257 - DNA, 16 bp, Artificial sequence
  Synthetic oligonucleotide
tgccatacagggcctc

SEQ ID NO: 1258 - DNA, 16 bp, Artificial sequence
  Synthetic oligonucleotide
gaaagagcagtggtgc

SEQ ID NO: 1259 - DNA, 16 bp, Artificial sequence
  Synthetic oligonucleotide
gggcatggaggtgtca

SEQ ID NO: 1260 - DNA, 16 bp, Artificial sequence
  Synthetic oligonucleotide
cgcgaaagtgtgtcac

SEQ ID NO: 1261 - DNA, 16 bp, Artificial sequence
  Synthetic oligonucleotide
tatcacccagcaggca

SEQ ID NO: 1262 - DNA, 16 bp, Artificial sequence
  Synthetic oligonucleotide
ggccagctggtaggcc

SEQ ID NO: 1263 - DNA, 16 bp, Artificial sequence
  Synthetic oligonucleotide
gtcaagctgagccagt

SEQ ID NO: 1264 - DNA, 16 bp, Artificial sequence
  Synthetic oligonucleotide
acagaagccgggcttc

SEQ ID NO: 1265 - DNA, 16 bp, Artificial sequence
  Synthetic oligonucleotide
atcaattttcacccag

SEQ ID NO: 1266 - DNA, 16 bp, Artificial sequence
  Synthetic oligonucleotide
gtgcatcaattttcac

SEQ ID NO: 1267 - DNA, 16 bp, Artificial sequence
  Synthetic oligonucleotide
aaagagtttaagggcg

SEQ ID NO: 1268 - DNA, 16 bp, Artificial sequence
  Synthetic oligonucleotide
ccacaacgagtaaaca

SEQ ID NO: 1269 - DNA, 16 bp, Artificial sequence
  Synthetic oligonucleotide
ggacagggtgaattgt

SEQ ID NO: 1270 - DNA, 16 bp, Artificial sequence
  Synthetic oligonucleotide
agtcacacctagaaat

SEQ ID NO: 1271 - DNA, 16 bp, Artificial sequence
  Synthetic oligonucleotide
gacttataggctcact

SEQ ID NO: 1272 - DNA, 16 bp, Artificial sequence
  Synthetic oligonucleotide
tactagacttataggc

SEQ ID NO: 1273 - DNA, 16 bp, Artificial sequence
  Synthetic oligonucleotide
gttactagacttatag

SEQ ID NO: 1274 - DNA, 16 bp, Artificial sequence
  Synthetic oligonucleotide
tgttactagacttata

SEQ ID NO: 1275 - DNA, 16 bp, Artificial sequence
  Synthetic oligonucleotide
atatagcagggacctg

SEQ ID NO: 1276 - DNA, 16 bp, Artificial sequence
  Synthetic oligonucleotide
ctaaatatagcaggga

SEQ ID NO: 1277 - DNA, 16 bp, Artificial sequence
  Synthetic oligonucleotide
cactaaatatagcagg

SEQ ID NO: 1278 - DNA, 16 bp, Artificial sequence
  Synthetic oligonucleotide
tttgagcccgagaggg

SEQ ID NO: 1279 - DNA, 16 bp, Artificial sequence
  Synthetic oligonucleotide
ttatttctaggcaggg

SEQ ID NO: 1280 - DNA, 16 bp, Artificial sequence
  Synthetic oligonucleotide
gtaaatttgaagctta

SEQ ID NO: 1281 - DNA, 16 bp, Artificial sequence
  Synthetic oligonucleotide
aattagaggacactgg

SEQ ID NO: 1282 - DNA, 16 bp, Artificial sequence
  Synthetic oligonucleotide
gctttaactcctagac

SEQ ID NO: 1283 - DNA, 16 bp, Artificial sequence
  Synthetic oligonucleotide
gtataccaaggttaat

SEQ ID NO: 1284 - DNA, 16 bp, Artificial sequence
  Synthetic oligonucleotide
cttaatagtagtatac

SEQ ID NO: 1285 - DNA, 16 bp, Artificial sequence
  Synthetic oligonucleotide
cacacgaggtctcact

SEQ ID NO: 1286 - DNA, 16 bp, Artificial sequence
  Synthetic oligonucleotide
ctacacacgaggtctc

SEQ ID NO: 1287 - DNA, 16 bp, Artificial sequence
  Synthetic oligonucleotide
tacattctggctttgg

SEQ ID NO: 1288 - DNA, 16 bp, Artificial sequence
  Synthetic oligonucleotide
tctcagtatgtatact

SEQ ID NO: 1289 - DNA, 16 bp, Artificial sequence
  Synthetic oligonucleotide
tgtccagtcctaagac

SEQ ID NO: 1290 - DNA, 16 bp, Artificial sequence
  Synthetic oligonucleotide
aatgtccagtcctaag

SEQ ID NO: 1291 - DNA, 16 bp, Artificial sequence
  Synthetic oligonucleotide
caatgtccagtcctaa

SEQ ID NO: 1292 - DNA, 16 bp, Artificial sequence
  Synthetic oligonucleotide
gcaatgtccagtccta

SEQ ID NO: 1293 - DNA, 16 bp, Artificial sequence
  Synthetic oligonucleotide
atgcaatgtccagtcc

SEQ ID NO: 1294 - DNA, 16 bp, Artificial sequence
  Synthetic oligonucleotide
gatgcaatgtccagtc

SEQ ID NO: 1295 - DNA, 16 bp, Artificial sequence
  Synthetic oligonucleotide
agatgcaatgtccagt

SEQ ID NO: 1296 - DNA, 16 bp, Artificial sequence
  Synthetic oligonucleotide
ctagatgcaatgtcca

SEQ ID NO: 1297 - DNA, 16 bp, Artificial sequence
  Synthetic oligonucleotide
gcttaaggagatccga

SEQ ID NO: 1298 - DNA, 16 bp, Artificial sequence
  Synthetic oligonucleotide
ggcttaaggagatccg

SEQ ID NO: 1299 - DNA, 16 bp, Artificial sequence
  Synthetic oligonucleotide
ggctgagttgcttccc

SEQ ID NO: 1300 - DNA, 16 bp, Artificial sequence
  Synthetic oligonucleotide
ttccagataagcccta

SEQ ID NO: 1301 - DNA, 16 bp, Artificial sequence
  Synthetic oligonucleotide
caccaatggccttctt

SEQ ID NO: 1302 - DNA, 16 bp, Artificial sequence
  Synthetic oligonucleotide
gaagatggctggacga

SEQ ID NO: 1303 - DNA, 16 bp, Artificial sequence
  Synthetic oligonucleotide
cagaagatggctggac

SEQ ID NO: 1304 - DNA, 16 bp, Artificial sequence
  Synthetic oligonucleotide
caataatttatcagtc

SEQ ID NO: 1305 - DNA, 16 bp, Artificial sequence
  Synthetic oligonucleotide
gggaaacctagcaagc

SEQ ID NO: 1306 - DNA, 16 bp, Artificial sequence
  Synthetic oligonucleotide
cccaaaggatagagta

SEQ ID NO: 1307 - DNA, 16 bp, Artificial sequence
  Synthetic oligonucleotide
ttacatgagtctagga

SEQ ID NO: 1308 - DNA, 16 bp, Artificial sequence
  Synthetic oligonucleotide
tattacatgagtctag

SEQ ID NO: 1309 - DNA, 16 bp, Artificial sequence
  Synthetic oligonucleotide
gattattacatgagtc

SEQ ID NO: 1310 - DNA, 16 bp, Artificial sequence
  Synthetic oligonucleotide
ggcaagaggattatta

SEQ ID NO: 1311 - DNA, 16 bp, Artificial sequence
  Synthetic oligonucleotide
agcaactttagggaga

SEQ ID NO: 1312 - DNA, 16 bp, Artificial sequence
  Synthetic oligonucleotide
gaacagacagttcagg

SEQ ID NO: 1313 - DNA, 16 bp, Artificial sequence
  Synthetic oligonucleotide
aagatatgtggttttg

SEQ ID NO: 1314 - DNA, 16 bp, Artificial sequence
  Synthetic oligonucleotide
gagcatcaccagccca

SEQ ID NO: 1315 - DNA, 16 bp, Artificial sequence
  Synthetic oligonucleotide
tagaaatgagtgggcg

SEQ ID NO: 1316 - DNA, 16 bp, Artificial sequence
  Synthetic oligonucleotide
agctacagcaatatag

SEQ ID NO: 1317 - DNA, 16 bp, Artificial sequence
  Synthetic oligonucleotide
actcacatggcctgat

SEQ ID NO: 1318 - DNA, 16 bp, Artificial sequence
  Synthetic oligonucleotide
ctagactagacaaaac

SEQ ID NO: 1319 - DNA, 16 bp, Artificial sequence
  Synthetic oligonucleotide
atatatatgtggaggc

SEQ ID NO: 1320 - DNA, 16 bp, Artificial sequence
  Synthetic oligonucleotide
ctaatacacaatgatc

SEQ ID NO: 1321 - DNA, 16 bp, Artificial sequence
  Synthetic oligonucleotide
caaaaaactaataccg

SEQ ID NO: 1322 - DNA, 16 bp, Artificial sequence
  Synthetic oligonucleotide
aaccagtaccagctgg

SEQ ID NO: 1323 - DNA, 16 bp, Artificial sequence
  Synthetic oligonucleotide
agaaactgtactggtc

SEQ ID NO: 1324 - DNA, 16 bp, Artificial sequence
  Synthetic oligonucleotide
ggatattcttaacagg

SEQ ID NO: 1325 - DNA, 16 bp, Artificial sequence
  Synthetic oligonucleotide
agctaggaaggatatt

SEQ ID NO: 1326 - DNA, 16 bp, Artificial sequence
  Synthetic oligonucleotide
aagtatgcgctgccat

SEQ ID NO: 1327 - DNA, 16 bp, Artificial sequence
  Synthetic oligonucleotide
tgggactgtaagtatg

SEQ ID NO: 1328 - DNA, 16 bp, Artificial sequence
  Synthetic oligonucleotide
ggatatagggtctccc

SEQ ID NO: 1329 - DNA, 16 bp, Artificial sequence
  Synthetic oligonucleotide
catgaggtaggacagc

SEQ ID NO: 1330 - DNA, 16 bp, Artificial sequence
  Synthetic oligonucleotide
gaaaaagccatgaggt

SEQ ID NO: 1331 - DNA, 16 bp, Artificial sequence
  Synthetic oligonucleotide
ccacagggttatctgg

SEQ ID NO: 1332 - DNA, 16 bp, Artificial sequence
  Synthetic oligonucleotide
aaggaggcttttaagc

SEQ ID NO: 1333 - DNA, 16 bp, Artificial sequence
  Synthetic oligonucleotide
aggaatgacaagtggt

SEQ ID NO: 1334 - DNA, 16 bp, Artificial sequence
  Synthetic oligonucleotide
cgcataggtggaacaa

SEQ ID NO: 1335 - DNA, 16 bp, Artificial sequence
  Synthetic oligonucleotide
caagaaaccaaacgca

SEQ ID NO: 1336 - DNA, 16 bp, Artificial sequence
  Synthetic oligonucleotide
aatatacgggcatgtt

SEQ ID NO: 1337 - DNA, 16 bp, Artificial sequence
  Synthetic oligonucleotide
aaatatacgggcatgt

SEQ ID NO: 1338 - DNA, 16 bp, Artificial sequence
  Synthetic oligonucleotide
aaaaatatacgggcat

SEQ ID NO: 1339 - DNA, 16 bp, Artificial sequence
  Synthetic oligonucleotide
acaaaaatatacgggc

SEQ ID NO: 1340 - DNA, 16 bp, Artificial sequence
  Synthetic oligonucleotide
tacaaaaatatacggg

SEQ ID NO: 1341 - DNA, 16 bp, Artificial sequence
  Synthetic oligonucleotide
tcaaacaaataggccg

SEQ ID NO: 1342 - DNA, 16 bp, Artificial sequence
  Synthetic oligonucleotide
atgcaagggactgcgc

SEQ ID NO: 1343 - DNA, 16 bp, Artificial sequence
  Synthetic oligonucleotide
acctatcgcatgccag

SEQ ID NO: 1344 - DNA, 16 bp, Artificial sequence
  Synthetic oligonucleotide
gttcaggtcagagcct

SEQ ID NO: 1345 - DNA, 16 bp, Artificial sequence
  Synthetic oligonucleotide
tctcaatgaaagtctc

SEQ ID NO: 1346 - DNA, 16 bp, Artificial sequence
  Synthetic oligonucleotide
gtaacaaccgctggga

SEQ ID NO: 1347 - DNA, 16 bp, Artificial sequence
  Synthetic oligonucleotide
ttaaagagtaacaacc

SEQ ID NO: 1348 - DNA, 16 bp, Artificial sequence
  Synthetic oligonucleotide
gcccagctaactaact

SEQ ID NO: 1349 - DNA, 16 bp, Artificial sequence
  Synthetic oligonucleotide
gactacagtacaggcg

SEQ ID NO: 1350 - DNA, 16 bp, Artificial sequence
  Synthetic oligonucleotide
agaacaagggaacacg

SEQ ID NO: 1351 - DNA, 16 bp, Artificial sequence
  Synthetic oligonucleotide
ccccatagaagaacaa

SEQ ID NO: 1352 - DNA, 16 bp, Artificial sequence
  Synthetic oligonucleotide
gattaggtattatggt

SEQ ID NO: 1353 - DNA, 16 bp, Artificial sequence
  Synthetic oligonucleotide
tcaaaaggattaggta

SEQ ID NO: 1354 - DNA, 16 bp, Artificial sequence
  Synthetic oligonucleotide
atccactgaatagtat

SEQ ID NO: 1355 - DNA, 16 bp, Artificial sequence
  Synthetic oligonucleotide
ctacaaaatcagatag

SEQ ID NO: 1356 - DNA, 16 bp, Artificial sequence
  Synthetic oligonucleotide
gacattagtggcttcc

SEQ ID NO: 1357 - DNA, 16 bp, Artificial sequence
  Synthetic oligonucleotide
aaccagcatggatgaa

SEQ ID NO: 1358 - DNA, 16 bp, Artificial sequence
  Synthetic oligonucleotide
tgcaaccttgcccccc

SEQ ID NO: 1359 - DNA, 16 bp, Artificial sequence
  Synthetic oligonucleotide
tagtattcaaaaaacg

SEQ ID NO: 1360 - DNA, 16 bp, Artificial sequence
  Synthetic oligonucleotide
caaattaaatacaccc

SEQ ID NO: 1361 - DNA, 16 bp, Artificial sequence
  Synthetic oligonucleotide
gaatactattctaaca

SEQ ID NO: 1362 - DNA, 16 bp, Artificial sequence
  Synthetic oligonucleotide
caccacaatttgctct

SEQ ID NO: 1363 - DNA, 16 bp, Artificial sequence
  Synthetic oligonucleotide
tcagaaaaggagggta

SEQ ID NO: 1364 - DNA, 16 bp, Artificial sequence
  Synthetic oligonucleotide
ttccacttcaagaacc

SEQ ID NO: 1365 - DNA, 16 bp, Artificial sequence
  Synthetic oligonucleotide
tgtaagcaactgtatt

SEQ ID NO: 1366 - DNA, 16 bp, Artificial sequence
  Synthetic oligonucleotide
tgagaagatatgctga

SEQ ID NO: 1367 - DNA, 16 bp, Artificial sequence
  Synthetic oligonucleotide
aacctatgtatcaaag

SEQ ID NO: 1368 - DNA, 16 bp, Artificial sequence
  Synthetic oligonucleotide
caaagtagttcctcca

SEQ ID NO: 1369 - DNA, 16 bp, Artificial sequence
  Synthetic oligonucleotide
tacaaagtagttcctc

SEQ ID NO: 1370 - DNA, 16 bp, Artificial sequence
  Synthetic oligonucleotide
cccaagagtaaaatac

SEQ ID NO: 1371 - DNA, 16 bp, Artificial sequence
  Synthetic oligonucleotide
acgaaaccaataagac

SEQ ID NO: 1372 - DNA, 16 bp, Artificial sequence
  Synthetic oligonucleotide
gaaaatacgaaaccaa

SEQ ID NO: 1373 - DNA, 16 bp, Artificial sequence
  Synthetic oligonucleotide
taataatggatggaac

SEQ ID NO: 1374 - DNA, 16 bp, Artificial sequence
  Synthetic oligonucleotide
tggtatcaggcaagaa

SEQ ID NO: 1375 - DNA, 16 bp, Artificial sequence
  Synthetic oligonucleotide
catgatgctgcaatca

SEQ ID NO: 1376 - DNA, 16 bp, Artificial sequence
  Synthetic oligonucleotide
cacaagcctgcggacc

SEQ ID NO: 1377 - DNA, 16 bp, Artificial sequence
  Synthetic oligonucleotide
gagcatagcagacaca

SEQ ID NO: 1378 - DNA, 16 bp, Artificial sequence
  Synthetic oligonucleotide
ggcaacatcactctaa

SEQ ID NO: 1379 - DNA, 16 bp, Artificial sequence
  Synthetic oligonucleotide
caaagagccttggcac

SEQ ID NO: 1380 - DNA, 16 bp, Artificial sequence
  Synthetic oligonucleotide
caggactagttcacta

SEQ ID NO: 1381 - DNA, 16 bp, Artificial sequence
  Synthetic oligonucleotide
atgaaattgggataac

SEQ ID NO: 1382 - DNA, 16 bp, Artificial sequence
  Synthetic oligonucleotide
atgaaggctgccactt

SEQ ID NO: 1383 - DNA, 16 bp, Artificial sequence
  Synthetic oligonucleotide
agcaagatcattgggt

SEQ ID NO: 1384 - DNA, 16 bp, Artificial sequence
  Synthetic oligonucleotide
ggaaaccttggactcc

SEQ ID NO: 1385 - DNA, 16 bp, Artificial sequence
  Synthetic oligonucleotide
gtctattggcacacag

SEQ ID NO: 1386 - DNA, 16 bp, Artificial sequence
  Synthetic oligonucleotide
gattaagtcatccggt

SEQ ID NO: 1387 - DNA, 16 bp, Artificial sequence
  Synthetic oligonucleotide
gggcactgcacaaagc

SEQ ID NO: 1388 - DNA, 16 bp, Artificial sequence
  Synthetic oligonucleotide
agtcagcggagactga

SEQ ID NO: 1389 - DNA, 16 bp, Artificial sequence
  Synthetic oligonucleotide
cggcaaaagaagctgg

SEQ ID NO: 1390 - DNA, 16 bp, Artificial sequence
  Synthetic oligonucleotide
agctagagcatcagct

SEQ ID NO: 1391 - DNA, 16 bp, Artificial sequence
  Synthetic oligonucleotide
ctggaaacagtctcgc

SEQ ID NO: 1392 - DNA, 16 bp, Artificial sequence
  Synthetic oligonucleotide
agccgaagtgtagtgg

SEQ ID NO: 1393 - DNA, 16 bp, Artificial sequence
  Synthetic oligonucleotide
ggccaagtctcccatc

SEQ ID NO: 1394 - DNA, 16 bp, Artificial sequence
  Synthetic oligonucleotide
ccggacccgttcttga

SEQ ID NO: 1395 - DNA, 16 bp, Artificial sequence
  Synthetic oligonucleotide
aggtagtgacctccag

SEQ ID NO: 1396 - DNA, 16 bp, Artificial sequence
  Synthetic oligonucleotide
acccacagtctgcatt

SEQ ID NO: 1397 - DNA, 16 bp, Artificial sequence
  Synthetic oligonucleotide
gcccaagtgaactaga

SEQ ID NO: 1398 - DNA, 16 bp, Artificial sequence
  Synthetic oligonucleotide
atgtatggatttccag

SEQ ID NO: 1399 - DNA, 16 bp, Artificial sequence
  Synthetic oligonucleotide
ttacagggtggtcagc

SEQ ID NO: 1400 - DNA, 16 bp, Artificial sequence
  Synthetic oligonucleotide
gtaaaacggttgtggt

SEQ ID NO: 1401 - DNA, 16 bp, Artificial sequence
  Synthetic oligonucleotide
caacaggtgtcctgct

SEQ ID NO: 1402 - DNA, 16 bp, Artificial sequence
  Synthetic oligonucleotide
tgtcatcctaactgct

SEQ ID NO: 1403 - DNA, 16 bp, Artificial sequence
  Synthetic oligonucleotide
agaaactggccggccc

SEQ ID NO: 1404 - DNA, 16 bp, Artificial sequence
  Synthetic oligonucleotide
tttatagtctccaacg

SEQ ID NO: 1405 - DNA, 16 bp, Artificial sequence
  Synthetic oligonucleotide
acggactggattatgc

SEQ ID NO: 1406 - DNA, 16 bp, Artificial sequence
  Synthetic oligonucleotide
ggctaaatcaatcttg

SEQ ID NO: 1407 - DNA, 16 bp, Artificial sequence
  Synthetic oligonucleotide
cgataatgacctaaat

SEQ ID NO: 1408 - DNA, 16 bp, Artificial sequence
  Synthetic oligonucleotide
ccgataatgacctaaa

SEQ ID NO: 1409 - DNA, 16 bp, Artificial sequence
  Synthetic oligonucleotide
gaatatcaacaccttg

SEQ ID NO: 1410 - DNA, 16 bp, Artificial sequence
  Synthetic oligonucleotide
agtgatatgctgccta

SEQ ID NO: 1411 - DNA, 16 bp, Artificial sequence
  Synthetic oligonucleotide
ggtttatttgcacctc

SEQ ID NO: 1412 - DNA, 16 bp, Artificial sequence
  Synthetic oligonucleotide
taccagggactcaact

SEQ ID NO: 1413 - DNA, 16 bp, Artificial sequence
  Synthetic oligonucleotide
ggccagacattgctgt

SEQ ID NO: 1414 - DNA, 16 bp, Artificial sequence
  Synthetic oligonucleotide
cacattggtggtcaag

SEQ ID NO: 1415 - DNA, 16 bp, Artificial sequence
  Synthetic oligonucleotide
ctcataacatttgacg

SEQ ID NO: 1416 - DNA, 16 bp, Artificial sequence
  Synthetic oligonucleotide
aaaaaagccggcacgg

SEQ ID NO: 1417 - DNA, 16 bp, Artificial sequence
  Synthetic oligonucleotide
aaaattggttgagtgc

SEQ ID NO: 1418 - DNA, 16 bp, Artificial sequence
  Synthetic oligonucleotide
gtaaaactcaggctga

SEQ ID NO: 1419 - DNA, 16 bp, Artificial sequence
  Synthetic oligonucleotide
caaaagagaacattcg

SEQ ID NO: 1420 - DNA, 16 bp, Artificial sequence
  Synthetic oligonucleotide
tgttatgtgggaatga

SEQ ID NO: 1421 - DNA, 16 bp, Artificial sequence
  Synthetic oligonucleotide
agggacacaacaggct

SEQ ID NO: 1422 - DNA, 16 bp, Artificial sequence
  Synthetic oligonucleotide
cacaatccactcctgg

SEQ ID NO: 1423 - DNA, 16 bp, Artificial sequence
  Synthetic oligonucleotide
ccacaatccactcctg

SEQ ID NO: 1424 - DNA, 16 bp, Artificial sequence
  Synthetic oligonucleotide
ttgcagaacaatgggc

SEQ ID NO: 1425 - DNA, 16 bp, Artificial sequence
  Synthetic oligonucleotide
gcgcagggtcccgtat

SEQ ID NO: 1426 - DNA, 16 bp, Artificial sequence
  Synthetic oligonucleotide
tattagagtggcagcc

SEQ ID NO: 1427 - DNA, 16 bp, Artificial sequence
  Synthetic oligonucleotide
tgccactcacaactgg

SEQ ID NO: 1428 - DNA, 16 bp, Artificial sequence
  Synthetic oligonucleotide
cgccataggaagctgc

SEQ ID NO: 1429 - DNA, 16 bp, Artificial sequence
  Synthetic oligonucleotide
gagcaggcgggcagct

SEQ ID NO: 1430 - DNA, 16 bp, Artificial sequence
  Synthetic oligonucleotide
aacagagcaggcgggc

SEQ ID NO: 1431 - DNA, 16 bp, Artificial sequence
  Synthetic oligonucleotide
taacagagcaggcggg

SEQ ID NO: 1432 - DNA, 16 bp, Artificial sequence
  Synthetic oligonucleotide
cattaacagagcaggc

SEQ ID NO: 1433 - DNA, 16 bp, Artificial sequence
  Synthetic oligonucleotide
gcattaacagagcagg

SEQ ID NO: 1434 - DNA, 16 bp, Artificial sequence
  Synthetic oligonucleotide
agccacatatgcctcc

SEQ ID NO: 1435 - DNA, 16 bp, Artificial sequence
  Synthetic oligonucleotide
tgttatgggccctcct

SEQ ID NO: 1436 - DNA, 16 bp, Artificial sequence
  Synthetic oligonucleotide
tccaaggctgtcagcg

SEQ ID NO: 1437 - DNA, 16 bp, Artificial sequence
  Synthetic oligonucleotide
cacgaggctgcagacc

SEQ ID NO: 1438 - DNA, 16 bp, Artificial sequence
  Synthetic oligonucleotide
ccgcaggtaggtgcca

SEQ ID NO: 1439 - DNA, 16 bp, Artificial sequence
  Synthetic oligonucleotide
gcccaagccttacagt

SEQ ID NO: 1440 - DNA, 16 bp, Artificial sequence
  Synthetic oligonucleotide
agccattggtcaccca

SEQ ID NO: 1441 - DNA, 16 bp, Artificial sequence
  Synthetic oligonucleotide
ccgcacccacctcagg

SEQ ID NO: 1442 - DNA, 16 bp, Artificial sequence
  Synthetic oligonucleotide
caccaatgaggcagac

SEQ ID NO: 1443 - DNA, 16 bp, Artificial sequence
  Synthetic oligonucleotide
gtggactgaggttcag

SEQ ID NO: 1444 - DNA, 16 bp, Artificial sequence
  Synthetic oligonucleotide
ctctaaccccatctcg

SEQ ID NO: 1445 - DNA, 16 bp, Artificial sequence
  Synthetic oligonucleotide
tcggcaggagcccaca

SEQ ID NO: 1446 - DNA, 16 bp, Artificial sequence
  Synthetic oligonucleotide
ccatatgctcagcaca

SEQ ID NO: 1447 - DNA, 16 bp, Artificial sequence
  Synthetic oligonucleotide
accatatgctcagcac

SEQ ID NO: 1448 - DNA, 16 bp, Artificial sequence
  Synthetic oligonucleotide
gataagcccacagagg

SEQ ID NO: 1449 - DNA, 16 bp, Artificial sequence
  Synthetic oligonucleotide
caacagataagcccac

SEQ ID NO: 1450 - DNA, 16 bp, Artificial sequence
  Synthetic oligonucleotide
acagaccacaaggctc

SEQ ID NO: 1451 - DNA, 16 bp, Artificial sequence
  Synthetic oligonucleotide
gaacagaccacaaggc

SEQ ID NO: 1452 - DNA, 16 bp, Artificial sequence
  Synthetic oligonucleotide
caggaaggcggtaggg

SEQ ID NO: 1453 - DNA, 16 bp, Artificial sequence
  Synthetic oligonucleotide
tgggaggacacttcca

SEQ ID NO: 1454 - DNA, 16 bp, Artificial sequence
  Synthetic oligonucleotide
catgaaatgggaggac

SEQ ID NO: 1455 - DNA, 16 bp, Artificial sequence
  Synthetic oligonucleotide
actgacttggccatcc

SEQ ID NO: 1456 - DNA, 16 bp, Artificial sequence
  Synthetic oligonucleotide
ccagactgtggagcca

SEQ ID NO: 1457 - DNA, 16 bp, Artificial sequence
  Synthetic oligonucleotide
gccaagacttctgcac

SEQ ID NO: 1458 - DNA, 16 bp, Artificial sequence
  Synthetic oligonucleotide
gcctacctggccatgg

SEQ ID NO: 1459 - DNA, 16 bp, Artificial sequence
  Synthetic oligonucleotide
gctgaccgggttcccc

SEQ ID NO: 1460 - DNA, 16 bp, Artificial sequence
  Synthetic oligonucleotide
tcctatccatgggccc

SEQ ID NO: 1461 - DNA, 16 bp, Artificial sequence
  Synthetic oligonucleotide
tactattgcatcattt

SEQ ID NO: 1462 - DNA, 16 bp, Artificial sequence
  Synthetic oligonucleotide
ccctagtgaacttccc

SEQ ID NO: 1463 - DNA, 16 bp, Artificial sequence
  Synthetic oligonucleotide
gcaaacctcagtctcg

SEQ ID NO: 1464 - DNA, 16 bp, Artificial sequence
  Synthetic oligonucleotide
gcacaattaagtagtt

SEQ ID NO: 1465 - DNA, 16 bp, Artificial sequence
  Synthetic oligonucleotide
gcatagagtagggctg

SEQ ID NO: 1466 - DNA, 16 bp, Artificial sequence
  Synthetic oligonucleotide
ccaaagcatagagtag

SEQ ID NO: 1467 - DNA, 16 bp, Artificial sequence
  Synthetic oligonucleotide
cccaaagcatagagta

SEQ ID NO: 1468 - DNA, 16 bp, Artificial sequence
  Synthetic oligonucleotide
cccatctgagctgtgt

SEQ ID NO: 1469 - DNA, 16 bp, Artificial sequence
  Synthetic oligonucleotide
tcgaatgacatttcct

SEQ ID NO: 1470 - DNA, 16 bp, Artificial sequence
  Synthetic oligonucleotide
agtaagacagggtaac

SEQ ID NO: 1471 - DNA, 16 bp, Artificial sequence
  Synthetic oligonucleotide
gtgcacccaggctgcc

SEQ ID NO: 1472 - DNA, 16 bp, Artificial sequence
  Synthetic oligonucleotide
ttccagcctccgtcat

SEQ ID NO: 1473 - DNA, 16 bp, Artificial sequence
  Synthetic oligonucleotide
cctaagggttttctgg

SEQ ID NO: 1474 - DNA, 16 bp, Artificial sequence
  Synthetic oligonucleotide
ccctaagggttttctg

SEQ ID NO: 1475 - DNA, 16 bp, Artificial sequence
  Synthetic oligonucleotide
ccagaagtctcctagg

SEQ ID NO: 1476 - DNA, 16 bp, Artificial sequence
  Synthetic oligonucleotide
ctaaaagttcccagac

SEQ ID NO: 1477 - DNA, 16 bp, Artificial sequence
  Synthetic oligonucleotide
ggagacgcagctctca

SEQ ID NO: 1478 - DNA, 16 bp, Artificial sequence
  Synthetic oligonucleotide
ggacaagcacccctct

SEQ ID NO: 1479 - DNA, 16 bp, Artificial sequence
  Synthetic oligonucleotide
cccgaccccggccaat

SEQ ID NO: 1480 - DNA, 16 bp, Artificial sequence
  Synthetic oligonucleotide
gttcactacagacatc

SEQ ID NO: 1481 - DNA, 16 bp, Artificial sequence
  Synthetic oligonucleotide
ttctagttcactacag

SEQ ID NO: 1482 - DNA, 16 bp, Artificial sequence
  Synthetic oligonucleotide
catagtaccccacaca

SEQ ID NO: 1483 - DNA, 16 bp, Artificial sequence
  Synthetic oligonucleotide
ttgtagtgtggaatat

SEQ ID NO: 1484 - DNA, 16 bp, Artificial sequence
  Synthetic oligonucleotide
cgcccaagagaacaca

SEQ ID NO: 1485 - DNA, 16 bp, Artificial sequence
  Synthetic oligonucleotide
ctccactttgtgtctg

SEQ ID NO: 1486 - DNA, 16 bp, Artificial sequence
  Synthetic oligonucleotide
gccttctgagcaaaca

SEQ ID NO: 1487 - DNA, 16 bp, Artificial sequence
  Synthetic oligonucleotide
aaaatgggtctgctgg

SEQ ID NO: 1488 - DNA, 16 bp, Artificial sequence
  Synthetic oligonucleotide
cattaaaatgggtctg

SEQ ID NO: 1489 - DNA, 16 bp, Artificial sequence
  Synthetic oligonucleotide
accttaagtttcttgt

SEQ ID NO: 1490 - DNA, 16 bp, Artificial sequence
  Synthetic oligonucleotide
tgcaatggagtccaaa

SEQ ID NO: 1491 - DNA, 16 bp, Artificial sequence
  Synthetic oligonucleotide
ccttaagttttttggt

SEQ ID NO: 1492 - DNA, 16 bp, Artificial sequence
  Synthetic oligonucleotide
tcatgattattaacct

SEQ ID NO: 1493 - DNA, 16 bp, Artificial sequence
  Synthetic oligonucleotide
aggcattgagaacttt

SEQ ID NO: 1494 - DNA, 16 bp, Artificial sequence
  Synthetic oligonucleotide
agctattcaacactga

SEQ ID NO: 1495 - DNA, 16 bp, Artificial sequence
  Synthetic oligonucleotide
cattagagtagctaat

SEQ ID NO: 1496 - DNA, 16 bp, Artificial sequence
  Synthetic oligonucleotide
ttgaattccgcatcat

SEQ ID NO: 1497 - DNA, 16 bp, Artificial sequence
  Synthetic oligonucleotide
aacaaaacaggacccg

SEQ ID NO: 1498 - DNA, 16 bp, Artificial sequence
  Synthetic oligonucleotide
gaagaaagtctgtact

SEQ ID NO: 1499 - DNA, 16 bp, Artificial sequence
  Synthetic oligonucleotide
ttgtagtgatcagttt

SEQ ID NO: 1500 - DNA, 16 bp, Artificial sequence
  Synthetic oligonucleotide
atccatgctgctatgc

SEQ ID NO: 1501 - DNA, 16 bp, Artificial sequence
  Synthetic oligonucleotide
ttgcacaacaaagagc

SEQ ID NO: 1502 - DNA, 16 bp, Artificial sequence
  Synthetic oligonucleotide
gatatattgctgggca

SEQ ID NO: 1503 - DNA, 16 bp, Artificial sequence
  Synthetic oligonucleotide
agatatattgctgggc

SEQ ID NO: 1504 - DNA, 16 bp, Artificial sequence
  Synthetic oligonucleotide
acctaaggaagctgac

SEQ ID NO: 1505 - DNA, 16 bp, Artificial sequence
  Synthetic oligonucleotide
ttaaagcccagcaaca

SEQ ID NO: 1506 - DNA, 16 bp, Artificial sequence
  Synthetic oligonucleotide
acgaaaaattcagatc

SEQ ID NO: 1507 - DNA, 16 bp, Artificial sequence
  Synthetic oligonucleotide
gacgaaaaattcagat

SEQ ID NO: 1508 - DNA, 16 bp, Artificial sequence
  Synthetic oligonucleotide
acagaattgttacaac

SEQ ID NO: 1509 - DNA, 16 bp, Artificial sequence
  Synthetic oligonucleotide
gtacagggtggacatt

SEQ ID NO: 1510 - DNA, 16 bp, Artificial sequence
  Synthetic oligonucleotide
acaaaagtacagggtg

SEQ ID NO: 1511 - DNA, 16 bp, Artificial sequence
  Synthetic oligonucleotide
tacaaaagtacagggt

SEQ ID NO: 1512 - DNA, 16 bp, Artificial sequence
  Synthetic oligonucleotide
atacaaaagtacaggg

SEQ ID NO: 1513 - DNA, 16 bp, Artificial sequence
  Synthetic oligonucleotide
agtcaaggagaacatg

SEQ ID NO: 1514 - DNA, 16 bp, Artificial sequence
  Synthetic oligonucleotide
ttgtagtgggtcacgc

SEQ ID NO: 1515 - DNA, 16 bp, Artificial sequence
  Synthetic oligonucleotide
catgattgcgccgttg

SEQ ID NO: 1516 - DNA, 16 bp, Artificial sequence
  Synthetic oligonucleotide
gtaattcactgcggat

SEQ ID NO: 1517 - DNA, 16 bp, Artificial sequence
  Synthetic oligonucleotide
aaacttgcagcagtgg

SEQ ID NO: 1518 - DNA, 16 bp, Artificial sequence
  Synthetic oligonucleotide
aaatggactagaaggg

SEQ ID NO: 1519 - DNA, 16 bp, Artificial sequence
  Synthetic oligonucleotide
agatagaaatcagggc

SEQ ID NO: 1520 - DNA, 16 bp, Artificial sequence
  Synthetic oligonucleotide
tcacagggtggacttg

SEQ ID NO: 1521 - DNA, 16 bp, Artificial sequence
  Synthetic oligonucleotide
gtagacacatgtcctt

SEQ ID NO: 1522 - DNA, 16 bp, Artificial sequence
  Synthetic oligonucleotide
gactacagtctgttcg

SEQ ID NO: 1523 - DNA, 16 bp, Artificial sequence
  Synthetic oligonucleotide
aacacaggagcagcat

SEQ ID NO: 1524 - DNA, 16 bp, Artificial sequence
  Synthetic oligonucleotide
aacgataaaacaacac

SEQ ID NO: 1525 - DNA, 16 bp, Artificial sequence
  Synthetic oligonucleotide
actgaatcaccagcag

SEQ ID NO: 1526 - DNA, 16 bp, Artificial sequence
  Synthetic oligonucleotide
gcctttacttaagata

SEQ ID NO: 1527 - DNA, 16 bp, Artificial sequence
  Synthetic oligonucleotide
acgcagtgtctcaggt

SEQ ID NO: 1528 - DNA, 16 bp, Artificial sequence
  Synthetic oligonucleotide
cacaagtagccttggc

SEQ ID NO: 1529 - DNA, 16 bp, Artificial sequence
  Synthetic oligonucleotide
tcacagtggacaccag

SEQ ID NO: 1530 - DNA, 16 bp, Artificial sequence
  Synthetic oligonucleotide
tgacagaccccaaagt

SEQ ID NO: 1531 - DNA, 16 bp, Artificial sequence
  Synthetic oligonucleotide
gaacaagctacatcaa

SEQ ID NO: 1532 - DNA, 16 bp, Artificial sequence
  Synthetic oligonucleotide
tggagagggttctctg

SEQ ID NO: 1533 - DNA, 16 bp, Artificial sequence
  Synthetic oligonucleotide
gataattggagagggt

SEQ ID NO: 1534 - DNA, 16 bp, Artificial sequence
  Synthetic oligonucleotide
gcgaacctttctcact

SEQ ID NO: 1535 - DNA, 16 bp, Artificial sequence
  Synthetic oligonucleotide
aaacaggatacgagac

SEQ ID NO: 1536 - DNA, 16 bp, Artificial sequence
  Synthetic oligonucleotide
gcacaaacaggatacg

SEQ ID NO: 1537 - DNA, 16 bp, Artificial sequence
  Synthetic oligonucleotide
taatccctttccgtca

SEQ ID NO: 1538 - DNA, 16 bp, Artificial sequence
  Synthetic oligonucleotide
tgtcttcgagccacac

SEQ ID NO: 1539 - DNA, 16 bp, Artificial sequence
  Synthetic oligonucleotide
ccctacagacacttgc

SEQ ID NO: 1540 - DNA, 16 bp, Artificial sequence
  Synthetic oligonucleotide
ccgtaggcagattcca

SEQ ID NO: 1541 - DNA, 16 bp, Artificial sequence
  Synthetic oligonucleotide
gcgaaaccagagagat

SEQ ID NO: 1542 - DNA, 16 bp, Artificial sequence
  Synthetic oligonucleotide
ggcgaaaccagagaga

SEQ ID NO: 1543 - DNA, 16 bp, Artificial sequence
  Synthetic oligonucleotide
agcttttaaacccccc

SEQ ID NO: 1544 - DNA, 16 bp, Artificial sequence
  Synthetic oligonucleotide
agccagattattaaca

SEQ ID NO: 1545 - DNA, 16 bp, Artificial sequence
  Synthetic oligonucleotide
gatgaggaggctggtc

SEQ ID NO: 1546 - DNA, 16 bp, Artificial sequence
  Synthetic oligonucleotide
acgaagaccccccagg

SEQ ID NO: 1547 - DNA, 16 bp, Artificial sequence
  Synthetic oligonucleotide
catgagaaaagggatc

SEQ ID NO: 1548 - DNA, 16 bp, Artificial sequence
  Synthetic oligonucleotide
caacaagtcagcccaa

SEQ ID NO: 1549 - DNA, 16 bp, Artificial sequence
  Synthetic oligonucleotide
acacaacaagtcagcc

SEQ ID NO: 1550 - DNA, 16 bp, Artificial sequence
  Synthetic oligonucleotide
ctacacaacaagtcag

SEQ ID NO: 1551 - DNA, 16 bp, Artificial sequence
  Synthetic oligonucleotide
ttctagcccgtcagcc

SEQ ID NO: 1552 - DNA, 16 bp, Artificial sequence
  Synthetic oligonucleotide
ttccagaagacctgtt

SEQ ID NO: 1553 - DNA, 16 bp, Artificial sequence
  Synthetic oligonucleotide
tagcactacaatcatt

SEQ ID NO: 1554 - DNA, 16 bp, Artificial sequence
  Synthetic oligonucleotide
aacgagacagcatcct

SEQ ID NO: 1555 - DNA, 16 bp, Artificial sequence
  Synthetic oligonucleotide
gcaattggtactgtac

SEQ ID NO: 1556 - DNA, 16 bp, Artificial sequence
  Synthetic oligonucleotide
acacagggcaattggt

SEQ ID NO: 1557 - DNA, 16 bp, Artificial sequence
  Synthetic oligonucleotide
tcgaactcaacctcag

SEQ ID NO: 1558 - DNA, 16 bp, Artificial sequence
  Synthetic oligonucleotide
tgcctcgggttcaagc

SEQ ID NO: 1559 - DNA, 16 bp, Artificial sequence
  Synthetic oligonucleotide
tgaaaggttctaggca

SEQ ID NO: 1560 - DNA, 16 bp, Artificial sequence
  Synthetic oligonucleotide
gtgaaaggttctaggc

SEQ ID NO: 1561 - DNA, 16 bp, Artificial sequence
  Synthetic oligonucleotide
tcgaaaggaaattctg

SEQ ID NO: 1562 - DNA, 16 bp, Artificial sequence
  Synthetic oligonucleotide
acattaaaggctcgaa

SEQ ID NO: 1563 - DNA, 16 bp, Artificial sequence
  Synthetic oligonucleotide
gtacattaaaggctcg

SEQ ID NO: 1564 - DNA, 16 bp, Artificial sequence
  Synthetic oligonucleotide
gtagaaacagtgggct

SEQ ID NO: 1565 - DNA, 16 bp, Artificial sequence
  Synthetic oligonucleotide
gtacactcagaaagga

SEQ ID NO: 1566 - DNA, 16 bp, Artificial sequence
  Synthetic oligonucleotide
gtgaatacaccaggat

SEQ ID NO: 1567 - DNA, 16 bp, Artificial sequence
  Synthetic oligonucleotide
actcaggcacaaccac

SEQ ID NO: 1568 - DNA, 16 bp, Artificial sequence
  Synthetic oligonucleotide
cgacagagctgtttaa

SEQ ID NO: 1569 - DNA, 16 bp, Artificial sequence
  Synthetic oligonucleotide
gcggaatgtaaattac

SEQ ID NO: 1570 - DNA, 16 bp, Artificial sequence
  Synthetic oligonucleotide
ctaaagaccactaatt

SEQ ID NO: 1571 - DNA, 16 bp, Artificial sequence
  Synthetic oligonucleotide
gactaaagaccactaa

SEQ ID NO: 1572 - DNA, 16 bp, Artificial sequence
  Synthetic oligonucleotide
gtacagagccatgact

SEQ ID NO: 1573 - DNA, 16 bp, Artificial sequence
  Synthetic oligonucleotide
taaaagcctggacaag

SEQ ID NO: 1574 - DNA, 16 bp, Artificial sequence
  Synthetic oligonucleotide
tacatctggactatgg

SEQ ID NO: 1575 - DNA, 16 bp, Artificial sequence
  Synthetic oligonucleotide
gatacctggatgtggg

SEQ ID NO: 1576 - DNA, 16 bp, Artificial sequence
  Synthetic oligonucleotide
gacaaaataggatgtg

SEQ ID NO: 1577 - DNA, 16 bp, Artificial sequence
  Synthetic oligonucleotide
aggaaagttattgatg

SEQ ID NO: 1578 - DNA, 16 bp, Artificial sequence
  Synthetic oligonucleotide
atacgaggaaagttat

SEQ ID NO: 1579 - DNA, 16 bp, Artificial sequence
  Synthetic oligonucleotide
aaaatacgaggaaagt

SEQ ID NO: 1580 - DNA, 16 bp, Artificial sequence
  Synthetic oligonucleotide
ggtaaaatacgaggaa

SEQ ID NO: 1581 - DNA, 16 bp, Artificial sequence
  Synthetic oligonucleotide
ccacatgtatatgggt

SEQ ID NO: 1582 - DNA, 16 bp, Artificial sequence
  Synthetic oligonucleotide
ccatacccaggagatc

SEQ ID NO: 1583 - DNA, 16 bp, Artificial sequence
  Synthetic oligonucleotide
aaccatttccctctgg

SEQ ID NO: 1584 - DNA, 16 bp, Artificial sequence
  Synthetic oligonucleotide
ggcgacctcagcaaag

SEQ ID NO: 1585 - DNA, 16 bp, Artificial sequence
  Synthetic oligonucleotide
aaggaagtccctgtga

SEQ ID NO: 1586 - DNA, 16 bp, Artificial sequence
  Synthetic oligonucleotide
ggcaaccacacatcca

SEQ ID NO: 1587 - DNA, 16 bp, Artificial sequence
  Synthetic oligonucleotide
actgagccgtttttca

SEQ ID NO: 1588 - DNA, 16 bp, Artificial sequence
  Synthetic oligonucleotide
ccgaagtgagagggtc

SEQ ID NO: 1589 - DNA, 16 bp, Artificial sequence
  Synthetic oligonucleotide
caaaatcgggttatct

SEQ ID NO: 1590 - DNA, 16 bp, Artificial sequence
  Synthetic oligonucleotide
gcaaaatcgggttatc

SEQ ID NO: 1591 - DNA, 16 bp, Artificial sequence
  Synthetic oligonucleotide
aaggatggatgtgtca

SEQ ID NO: 1592 - DNA, 16 bp, Artificial sequence
  Synthetic oligonucleotide
tgacatgcgggaatga

SEQ ID NO: 1593 - DNA, 16 bp, Artificial sequence
  Synthetic oligonucleotide
agtagaaactgggacg

SEQ ID NO: 1594 - DNA, 16 bp, Artificial sequence
  Synthetic oligonucleotide
agctataaaaccagcc

SEQ ID NO: 1595 - DNA, 16 bp, Artificial sequence
  Synthetic oligonucleotide
tacaaaagagtatagc

SEQ ID NO: 1596 - DNA, 16 bp, Artificial sequence
  Synthetic oligonucleotide
caccactgcacggcct

SEQ ID NO: 1597 - DNA, 16 bp, Artificial sequence
  Synthetic oligonucleotide
aacataacccccatct

SEQ ID NO: 1598 - DNA, 16 bp, Artificial sequence
  Synthetic oligonucleotide
agcaatggtagagggc

SEQ ID NO: 1599 - DNA, 16 bp, Artificial sequence
  Synthetic oligonucleotide
gcaatggtggccgggc

SEQ ID NO: 1600 - DNA, 16 bp, Artificial sequence
  Synthetic oligonucleotide
ttcaacaggctgggtc

SEQ ID NO: 1601 - DNA, 16 bp, Artificial sequence
  Synthetic oligonucleotide
tactatattcaacagg

SEQ ID NO: 1602 - DNA, 16 bp, Artificial sequence
  Synthetic oligonucleotide
ccacacataggccata

SEQ ID NO: 1603 - DNA, 16 bp, Artificial sequence
  Synthetic oligonucleotide
atacactgagatcagg

SEQ ID NO: 1604 - DNA, 16 bp, Artificial sequence
  Synthetic oligonucleotide
gctgggatatacgccc

SEQ ID NO: 1605 - DNA, 16 bp, Artificial sequence
  Synthetic oligonucleotide
acggagacccttacct

SEQ ID NO: 1606 - DNA, 16 bp, Artificial sequence
  Synthetic oligonucleotide
ttgcagattagcaggg

SEQ ID NO: 1607 - DNA, 16 bp, Artificial sequence
  Synthetic oligonucleotide
acaaactgagtgttga

SEQ ID NO: 1608 - DNA, 16 bp, Artificial sequence
  Synthetic oligonucleotide
acacaaactgagtgtt

SEQ ID NO: 1609 - DNA, 16 bp, Artificial sequence
  Synthetic oligonucleotide
cgcaagaagacattaa

SEQ ID NO: 1610 - DNA, 16 bp, Artificial sequence
  Synthetic oligonucleotide
ggcagcatggctaagc

SEQ ID NO: 1611 - DNA, 16 bp, Artificial sequence
  Synthetic oligonucleotide
acgaaagtgaggagtc

SEQ ID NO: 1612 - DNA, 16 bp, Artificial sequence
  Synthetic oligonucleotide
ggacgaaagtgaggag

SEQ ID NO: 1613 - DNA, 16 bp, Artificial sequence
  Synthetic oligonucleotide
tacgaaatagcagagc

SEQ ID NO: 1614 - DNA, 16 bp, Artificial sequence
  Synthetic oligonucleotide
gcccattggcccatcg

SEQ ID NO: 1615 - DNA, 16 bp, Artificial sequence
  Synthetic oligonucleotide
gatcacccgccactgt

SEQ ID NO: 1616 - DNA, 16 bp, Artificial sequence
  Synthetic oligonucleotide
caccagggactcatta

SEQ ID NO: 1617 - DNA, 16 bp, Artificial sequence
  Synthetic oligonucleotide
acacagtggtggtccc

SEQ ID NO: 1618 - DNA, 16 bp, Artificial sequence
  Synthetic oligonucleotide
tgctttaaggctaaca

SEQ ID NO: 1619 - DNA, 16 bp, Artificial sequence
  Synthetic oligonucleotide
ggcctgcgctctgtgc

SEQ ID NO: 1620 - DNA, 16 bp, Artificial sequence
  Synthetic oligonucleotide
tgccctaaggcaagtg

SEQ ID NO: 1621 - DNA, 16 bp, Artificial sequence
  Synthetic oligonucleotide
caacagccacaggatc

SEQ ID NO: 1622 - DNA, 16 bp, Artificial sequence
  Synthetic oligonucleotide
ttccaccaacagccac

SEQ ID NO: 1623 - DNA, 16 bp, Artificial sequence
  Synthetic oligonucleotide
aactatgcatccacct

SEQ ID NO: 1624 - DNA, 16 bp, Artificial sequence
  Synthetic oligonucleotide
tgcaactatgcatcca

SEQ ID NO: 1625 - DNA, 16 bp, Artificial sequence
  Synthetic oligonucleotide
ggctaggtggtgtgcg

SEQ ID NO: 1626 - DNA, 16 bp, Artificial sequence
  Synthetic oligonucleotide
gagattggagcctggt

SEQ ID NO: 1627 - DNA, 16 bp, Artificial sequence
  Synthetic oligonucleotide
aataagagattggagc

SEQ ID NO: 1628 - DNA, 16 bp, Artificial sequence
  Synthetic oligonucleotide
caataagagattggag

SEQ ID NO: 1629 - DNA, 16 bp, Artificial sequence
  Synthetic oligonucleotide
gcaataagagattgga

SEQ ID NO: 1630 - DNA, 16 bp, Artificial sequence
  Synthetic oligonucleotide
gtgaatccaacagaca

SEQ ID NO: 1631 - DNA, 16 bp, Artificial sequence
  Synthetic oligonucleotide
caacatgccttccagt

SEQ ID NO: 1632 - DNA, 16 bp, Artificial sequence
  Synthetic oligonucleotide
tgccactccctatccc

SEQ ID NO: 1633 - DNA, 16 bp, Artificial sequence
  Synthetic oligonucleotide
gcttaatgccttgcct

SEQ ID NO: 1634 - DNA, 16 bp, Artificial sequence
  Synthetic oligonucleotide
ccgcaatgtgttcatt

SEQ ID NO: 1635 - DNA, 16 bp, Artificial sequence
  Synthetic oligonucleotide
gtataccccacaaggc

SEQ ID NO: 1636 - DNA, 16 bp, Artificial sequence
  Synthetic oligonucleotide
gtaaagggtggcagcc

SEQ ID NO: 1637 - DNA, 16 bp, Artificial sequence
  Synthetic oligonucleotide
agtcactttaacaagt

SEQ ID NO: 1638 - DNA, 16 bp, Artificial sequence
  Synthetic oligonucleotide
gctaccaaggcacaga

SEQ ID NO: 1639 - DNA, 16 bp, Artificial sequence
  Synthetic oligonucleotide
catggccacgatggca

SEQ ID NO: 1640 - DNA, 16 bp, Artificial sequence
  Synthetic oligonucleotide
gaagagacagcatacc

SEQ ID NO: 1641 - DNA, 16 bp, Artificial sequence
  Synthetic oligonucleotide
agttatggttcactgg

SEQ ID NO: 1642 - DNA, 16 bp, Artificial sequence
  Synthetic oligonucleotide
actcagagtttacggg

SEQ ID NO: 1643 - DNA, 16 bp, Artificial sequence
  Synthetic oligonucleotide
ttccggtgagcacacc

SEQ ID NO: 1644 - DNA, 16 bp, Artificial sequence
  Synthetic oligonucleotide
gaatcaggagggagat

SEQ ID NO: 1645 - DNA, 16 bp, Artificial sequence
  Synthetic oligonucleotide
ggcaagtgaccaggtg

SEQ ID NO: 1646 - DNA, 16 bp, Artificial sequence
  Synthetic oligonucleotide
acgaaggcggcaagtg

SEQ ID NO: 1647 - DNA, 16 bp, Artificial sequence
  Synthetic oligonucleotide
gcagagagagtccatt

SEQ ID NO: 1648 - DNA, 16 bp, Artificial sequence
  Synthetic oligonucleotide
gcgcagagagagtcca

SEQ ID NO: 1649 - DNA, 16 bp, Artificial sequence
  Synthetic oligonucleotide
gcccagtaggcaagaa

SEQ ID NO: 1650 - DNA, 16 bp, Artificial sequence
  Synthetic oligonucleotide
aagtaacccccatcac

SEQ ID NO: 1651 - DNA, 16 bp, Artificial sequence
  Synthetic oligonucleotide
ctagatacaaggctgc

SEQ ID NO: 1652 - DNA, 16 bp, Artificial sequence
  Synthetic oligonucleotide
cgccagcttggtctgc

SEQ ID NO: 1653 - DNA, 16 bp, Artificial sequence
  Synthetic oligonucleotide
acgcaaatatctccca

SEQ ID NO: 1654 - DNA, 16 bp, Artificial sequence
  Synthetic oligonucleotide
ctaatccgaggcaata

SEQ ID NO: 1655 - DNA, 16 bp, Artificial sequence
  Synthetic oligonucleotide
gcacacaacacttccc

SEQ ID NO: 1656 - DNA, 16 bp, Artificial sequence
  Synthetic oligonucleotide
ggcaggatccactcat

SEQ ID NO: 1657 - DNA, 16 bp, Artificial sequence
  Synthetic oligonucleotide
aggagaggagatctgc

SEQ ID NO: 1658 - DNA, 16 bp, Artificial sequence
  Synthetic oligonucleotide
acacaatgacgaggct

SEQ ID NO: 1659 - DNA, 16 bp, Artificial sequence
  Synthetic oligonucleotide
tgttagtctcagggaa

SEQ ID NO: 1660 - DNA, 16 bp, Artificial sequence
  Synthetic oligonucleotide
acaaacacggctcagc

SEQ ID NO: 1661 - DNA, 16 bp, Artificial sequence
  Synthetic oligonucleotide
cgacacccagctccgg

SEQ ID NO: 1662 - DNA, 16 bp, Artificial sequence
  Synthetic oligonucleotide
ttgaaatgcccaggtc

SEQ ID NO: 1663 - DNA, 16 bp, Artificial sequence
  Synthetic oligonucleotide
ttcaaaggagcttgtg

SEQ ID NO: 1664 - DNA, 16 bp, Artificial sequence
  Synthetic oligonucleotide
tgcaagctgccacctt

SEQ ID NO: 1665 - DNA, 16 bp, Artificial sequence
  Synthetic oligonucleotide
tgctaaacagtcaatc

SEQ ID NO: 1666 - DNA, 16 bp, Artificial sequence
  Synthetic oligonucleotide
aacctaggaggacatc

SEQ ID NO: 1667 - DNA, 16 bp, Artificial sequence
  Synthetic oligonucleotide
ccctactgaagctgga

SEQ ID NO: 1668 - DNA, 16 bp, Artificial sequence
  Synthetic oligonucleotide
aatcacgctgccaagg

SEQ ID NO: 1669 - DNA, 16 bp, Artificial sequence
  Synthetic oligonucleotide
tcagagaggttcgcag

SEQ ID NO: 1670 - DNA, 16 bp, Artificial sequence
  Synthetic oligonucleotide
cggcaaactgcaaagc

SEQ ID NO: 1671 - DNA, 16 bp, Artificial sequence
  Synthetic oligonucleotide
caacaagccactgagc

SEQ ID NO: 1672 - DNA, 16 bp, Artificial sequence
  Synthetic oligonucleotide
taacaatccactggcc

SEQ ID NO: 1673 - DNA, 16 bp, Artificial sequence
  Synthetic oligonucleotide
gctcaagtgctggaga

SEQ ID NO: 1674 - DNA, 16 bp, Artificial sequence
  Synthetic oligonucleotide
caagatcctacatgta

SEQ ID NO: 1675 - DNA, 16 bp, Artificial sequence
  Synthetic oligonucleotide
taaaagcttccaccag

SEQ ID NO: 1676 - DNA, 16 bp, Artificial sequence
  Synthetic oligonucleotide
cccaatagaggtttaa

SEQ ID NO: 1677 - DNA, 16 bp, Artificial sequence
  Synthetic oligonucleotide
tctcatacttcggcct

SEQ ID NO: 1678 - DNA, 16 bp, Artificial sequence
  Synthetic oligonucleotide
caacagaggttttttg

SEQ ID NO: 1679 - DNA, 16 bp, Artificial sequence
  Synthetic oligonucleotide
gtgaaagtaaatgctg

SEQ ID NO: 1680 - DNA, 16 bp, Artificial sequence
  Synthetic oligonucleotide
aacagaaccacaccag

SEQ ID NO: 1681 - DNA, 16 bp, Artificial sequence
  Synthetic oligonucleotide
ccagaaaaccgtttct

SEQ ID NO: 1682 - DNA, 16 bp, Artificial sequence
  Synthetic oligonucleotide
atgcaggctgggaacc

SEQ ID NO: 1683 - DNA, 16 bp, Artificial sequence
  Synthetic oligonucleotide
tgccagactttggagc

SEQ ID NO: 1684 - DNA, 16 bp, Artificial sequence
  Synthetic oligonucleotide
cccaagtccgcccagt

SEQ ID NO: 1685 - DNA, 16 bp, Artificial sequence
  Synthetic oligonucleotide
ctgaatctaggtgtct

SEQ ID NO: 1686 - DNA, 16 bp, Artificial sequence
  Synthetic oligonucleotide
cttgaatgtccatgcc

SEQ ID NO: 1687 - DNA, 16 bp, Artificial sequence
  Synthetic oligonucleotide
atatagagagctttac

SEQ ID NO: 1688 - DNA, 16 bp, Artificial sequence
  Synthetic oligonucleotide
ctaatatagagagctt

SEQ ID NO: 1689 - DNA, 16 bp, Artificial sequence
  Synthetic oligonucleotide
tctaatatagagagct

SEQ ID NO: 1690 - DNA, 16 bp, Artificial sequence
  Synthetic oligonucleotide
ccccataacacttact

SEQ ID NO: 1691 - DNA, 16 bp, Artificial sequence
  Synthetic oligonucleotide
agctactctctcaagt

SEQ ID NO: 1692 - DNA, 16 bp, Artificial sequence
  Synthetic oligonucleotide
gggcaagctactctct

SEQ ID NO: 1693 - DNA, 16 bp, Artificial sequence
  Synthetic oligonucleotide
agctacggtctgagca

SEQ ID NO: 1694 - DNA, 16 bp, Artificial sequence
  Synthetic oligonucleotide
agtcagagggcctgcc

SEQ ID NO: 1695 - DNA, 16 bp, Artificial sequence
  Synthetic oligonucleotide
gctcactttggattgt

SEQ ID NO: 1696 - DNA, 16 bp, Artificial sequence
  Synthetic oligonucleotide
gtctacaaagcccagc

SEQ ID NO: 1697 - DNA, 16 bp, Artificial sequence
  Synthetic oligonucleotide
aaagagaccatctccc

SEQ ID NO: 1698 - DNA, 16 bp, Artificial sequence
  Synthetic oligonucleotide
gggaaacactcggccg

SEQ ID NO: 1699 - DNA, 16 bp, Artificial sequence
  Synthetic oligonucleotide
caatgaggacatctgc

SEQ ID NO: 1700 - DNA, 16 bp, Artificial sequence
  Synthetic oligonucleotide
gggcaatgaggacatc

SEQ ID NO: 1701 - DNA, 16 bp, Artificial sequence
  Synthetic oligonucleotide
aggaacttcgcctctt

SEQ ID NO: 1702 - DNA, 16 bp, Artificial sequence
  Synthetic oligonucleotide
tcctaagccagatagc

SEQ ID NO: 1703 - DNA, 16 bp, Artificial sequence
  Synthetic oligonucleotide
tctaagatccccattt

SEQ ID NO: 1704 - DNA, 16 bp, Artificial sequence
  Synthetic oligonucleotide
tttcaccgtcccatca

SEQ ID NO: 1705 - DNA, 16 bp, Artificial sequence
  Synthetic oligonucleotide
aataacacagccatgc

SEQ ID NO: 1706 - DNA, 16 bp, Artificial sequence
  Synthetic oligonucleotide
acccaccccggagatg

SEQ ID NO: 1707 - DNA, 16 bp, Artificial sequence
  Synthetic oligonucleotide
taataagtcacactgg

SEQ ID NO: 1708 - DNA, 16 bp, Artificial sequence
  Synthetic oligonucleotide
gtaataagtcacactg

SEQ ID NO: 1709 - DNA, 16 bp, Artificial sequence
  Synthetic oligonucleotide
ctatgatctatgatca

SEQ ID NO: 1710 - DNA, 16 bp, Artificial sequence
  Synthetic oligonucleotide
tccgtataagatgtga

SEQ ID NO: 1711 - DNA, 16 bp, Artificial sequence
  Synthetic oligonucleotide
ctattatccagcactg

SEQ ID NO: 1712 - DNA, 16 bp, Artificial sequence
  Synthetic oligonucleotide
agctactgtagtgatg

SEQ ID NO: 1713 - DNA, 16 bp, Artificial sequence
  Synthetic oligonucleotide
tcgaattttcagagta

SEQ ID NO: 1714 - DNA, 16 bp, Artificial sequence
  Synthetic oligonucleotide
acggaaggtggctgcc

SEQ ID NO: 1715 - DNA, 16 bp, Artificial sequence
  Synthetic oligonucleotide
gcaaatataaggcatg

SEQ ID NO: 1716 - DNA, 16 bp, Artificial sequence
  Synthetic oligonucleotide
cacagattgaggacaa

SEQ ID NO: 1717 - DNA, 16 bp, Artificial sequence
  Synthetic oligonucleotide
tgacaagcagtgtggg

SEQ ID NO: 1718 - DNA, 16 bp, Artificial sequence
  Synthetic oligonucleotide
ggtatctgaaagtcac

SEQ ID NO: 1719 - DNA, 16 bp, Artificial sequence
  Synthetic oligonucleotide
ccacaaggtagaggga

SEQ ID NO: 1720 - DNA, 16 bp, Artificial sequence
  Synthetic oligonucleotide
caaggagcccacaagg

SEQ ID NO: 1721 - DNA, 16 bp, Artificial sequence
  Synthetic oligonucleotide
gcccaagtccttgtgg

SEQ ID NO: 1722 - DNA, 16 bp, Artificial sequence
  Synthetic oligonucleotide
gattaaggtgatgctg

SEQ ID NO: 1723 - DNA, 16 bp, Artificial sequence
  Synthetic oligonucleotide
tgattaaggtgatgct

SEQ ID NO: 1724 - DNA, 16 bp, Artificial sequence
  Synthetic oligonucleotide
aggaagcaccaggata

SEQ ID NO: 1725 - DNA, 16 bp, Artificial sequence
  Synthetic oligonucleotide
catattatgaatcccc

SEQ ID NO: 1726 - DNA, 16 bp, Artificial sequence
  Synthetic oligonucleotide
tgacatattatgaatc

SEQ ID NO: 1727 - DNA, 16 bp, Artificial sequence
  Synthetic oligonucleotide
atgacaagggtcttgg

SEQ ID NO: 1728 - DNA, 16 bp, Artificial sequence
  Synthetic oligonucleotide
taatgacccaggctgg

SEQ ID NO: 1729 - DNA, 16 bp, Artificial sequence
  Synthetic oligonucleotide
gcctaccgtgtggcga

SEQ ID NO: 1730 - DNA, 16 bp, Artificial sequence
  Synthetic oligonucleotide
ccagaaacggtcagtg

SEQ ID NO: 1731 - DNA, 16 bp, Artificial sequence
  Synthetic oligonucleotide
tgtgaatgggcacatg

SEQ ID NO: 1732 - DNA, 16 bp, Artificial sequence
  Synthetic oligonucleotide
caaacaacttcttggc

SEQ ID NO: 1733 - DNA, 16 bp, Artificial sequence
  Synthetic oligonucleotide
gaagactggttctggc

SEQ ID NO: 1734 - DNA, 16 bp, Artificial sequence
  Synthetic oligonucleotide
ttacagaagactggtt

SEQ ID NO: 1735 - DNA, 16 bp, Artificial sequence
  Synthetic oligonucleotide
ggcaaggtggctaaaa

SEQ ID NO: 1736 - DNA, 16 bp, Artificial sequence
  Synthetic oligonucleotide
aggaacccatcatggt

SEQ ID NO: 1737 - DNA, 16 bp, Artificial sequence
  Synthetic oligonucleotide
tgacaaggtaggtttt

SEQ ID NO: 1738 - DNA, 16 bp, Artificial sequence
  Synthetic oligonucleotide
ttgacaaggtaggttt

SEQ ID NO: 1739 - DNA, 16 bp, Artificial sequence
  Synthetic oligonucleotide
caaaactggttgacaa

SEQ ID NO: 1740 - DNA, 16 bp, Artificial sequence
  Synthetic oligonucleotide
tgcaaaactggttgac

SEQ ID NO: 1741 - DNA, 16 bp, Artificial sequence
  Synthetic oligonucleotide
gtgaagtgcagtagct

SEQ ID NO: 1742 - DNA, 16 bp, Artificial sequence
  Synthetic oligonucleotide
taagatagagggtctt

SEQ ID NO: 1743 - DNA, 16 bp, Artificial sequence
  Synthetic oligonucleotide
gctaacaatttaagga

SEQ ID NO: 1744 - DNA, 16 bp, Artificial sequence
  Synthetic oligonucleotide
ctgagaggcatacaaa

SEQ ID NO: 1745 - DNA, 16 bp, Artificial sequence
  Synthetic oligonucleotide
ggagaagaagtgagcc

SEQ ID NO: 1746 - DNA, 16 bp, Artificial sequence
  Synthetic oligonucleotide
acaaatggatgaggcc

SEQ ID NO: 1747 - DNA, 16 bp, Artificial sequence
  Synthetic oligonucleotide
gacaaatggatgaggc

SEQ ID NO: 1748 - DNA, 16 bp, Artificial sequence
  Synthetic oligonucleotide
gacaaacagatgaggc

SEQ ID NO: 1749 - DNA, 16 bp, Artificial sequence
  Synthetic oligonucleotide
gaataaatttcagccc

SEQ ID NO: 1750 - DNA, 16 bp, Artificial sequence
  Synthetic oligonucleotide
ttcaatggcacagttc

SEQ ID NO: 1751 - DNA, 16 bp, Artificial sequence
  Synthetic oligonucleotide
tcagacttgaggatgt

SEQ ID NO: 1752 - DNA, 16 bp, Artificial sequence
  Synthetic oligonucleotide
gcacaaacaggcccgc

SEQ ID NO: 1753 - DNA, 16 bp, Artificial sequence
  Synthetic oligonucleotide
gtcaagttcaacactg

SEQ ID NO: 1754 - DNA, 16 bp, Artificial sequence
  Synthetic oligonucleotide
gctcagggttaccttg

SEQ ID NO: 1755 - DNA, 16 bp, Artificial sequence
  Synthetic oligonucleotide
aggaagtgccatgttc

SEQ ID NO: 1756 - DNA, 16 bp, Artificial sequence
  Synthetic oligonucleotide
tcccactctggcaaca

SEQ ID NO: 1757 - DNA, 16 bp, Artificial sequence
  Synthetic oligonucleotide
agctagatgggaccta

SEQ ID NO: 1758 - DNA, 16 bp, Artificial sequence
  Synthetic oligonucleotide
gaagttcccgttctga

SEQ ID NO: 1759 - DNA, 16 bp, Artificial sequence
  Synthetic oligonucleotide
aaatagacgatctcac

SEQ ID NO: 1760 - DNA, 16 bp, Artificial sequence
  Synthetic oligonucleotide
agggaaatagacgatc

SEQ ID NO: 1761 - DNA, 16 bp, Artificial sequence
  Synthetic oligonucleotide
tcgaagggaaatagac

SEQ ID NO: 1762 - DNA, 16 bp, Artificial sequence
  Synthetic oligonucleotide
gtagaaggatctgact

SEQ ID NO: 1763 - DNA, 16 bp, Artificial sequence
  Synthetic oligonucleotide
cagtagaaggatctga

SEQ ID NO: 1764 - DNA, 16 bp, Artificial sequence
  Synthetic oligonucleotide
gtgaagatctctggtg

SEQ ID NO: 1765 - DNA, 16 bp, Artificial sequence
  Synthetic oligonucleotide
ccagagtgaagatctc

SEQ ID NO: 1766 - DNA, 16 bp, Artificial sequence
  Synthetic oligonucleotide
ctgcagatcaactgct

SEQ ID NO: 1767 - DNA, 16 bp, Artificial sequence
  Synthetic oligonucleotide
ccacaagtcattccag

SEQ ID NO: 1768 - DNA, 16 bp, Artificial sequence
  Synthetic oligonucleotide
ttccaggactacctct

SEQ ID NO: 1769 - DNA, 16 bp, Artificial sequence
  Synthetic oligonucleotide
ggctttgggaaacctc

SEQ ID NO: 1770 - DNA, 16 bp, Artificial sequence
  Synthetic oligonucleotide
tattaaggacaacctc

SEQ ID NO: 1771 - DNA, 16 bp, Artificial sequence
  Synthetic oligonucleotide
ttattaaggacaacct

SEQ ID NO: 1772 - DNA, 16 bp, Artificial sequence
  Synthetic oligonucleotide
tgttattaaggacaac

SEQ ID NO: 1773 - DNA, 16 bp, Artificial sequence
  Synthetic oligonucleotide
tggcacacggcaaata

SEQ ID NO: 1774 - DNA, 16 bp, Artificial sequence
  Synthetic oligonucleotide
tcataagggtgagcct

SEQ ID NO: 1775 - DNA, 16 bp, Artificial sequence
  Synthetic oligonucleotide
tcacagggtggtcata

SEQ ID NO: 1776 - DNA, 16 bp, Artificial sequence
  Synthetic oligonucleotide
gaagatggtcacagcc

SEQ ID NO: 1777 - DNA, 16 bp, Artificial sequence
  Synthetic oligonucleotide
gtcgaatgaagatggt

SEQ ID NO: 1778 - DNA, 16 bp, Artificial sequence
  Synthetic oligonucleotide
ggcctgaaagagccca

SEQ ID NO: 1779 - DNA, 16 bp, Artificial sequence
  Synthetic oligonucleotide
gataaggaccccaccc

SEQ ID NO: 1780 - DNA, 16 bp, Artificial sequence
  Synthetic oligonucleotide
aaagaaggagttacgg

SEQ ID NO: 1781 - DNA, 16 bp, Artificial sequence
  Synthetic oligonucleotide
acgaatgcatacaaat

SEQ ID NO: 1782 - DNA, 16 bp, Artificial sequence
  Synthetic oligonucleotide
tgaaaaacgaatgcat

SEQ ID NO: 1783 - DNA, 16 bp, Artificial sequence
  Synthetic oligonucleotide
caccagtggctgtctg

SEQ ID NO: 1784 - DNA, 16 bp, Artificial sequence
  Synthetic oligonucleotide
tcataataggccgggt

SEQ ID NO: 1785 - DNA, 16 bp, Artificial sequence
  Synthetic oligonucleotide
ataataaccaccgaag

SEQ ID NO: 1786 - DNA, 16 bp, Artificial sequence
  Synthetic oligonucleotide
ataataataaccaccg

SEQ ID NO: 1787 - DNA, 16 bp, Artificial sequence
  Synthetic oligonucleotide
cctaggatttgtgtta

SEQ ID NO: 1788 - DNA, 16 bp, Artificial sequence
  Synthetic oligonucleotide
gcctaggatttataga

SEQ ID NO: 1789 - DNA, 16 bp, Artificial sequence
  Synthetic oligonucleotide
ccacaaatgaatggta

SEQ ID NO: 1790 - DNA, 16 bp, Artificial sequence
  Synthetic oligonucleotide
tgggatgtggtctggt

SEQ ID NO: 1791 - DNA, 16 bp, Artificial sequence
  Synthetic oligonucleotide
ctaattaccagctaac

SEQ ID NO: 1792 - DNA, 16 bp, Artificial sequence
  Synthetic oligonucleotide
acttaggttactccta

SEQ ID NO: 1793 - DNA, 16 bp, Artificial sequence
  Synthetic oligonucleotide
aactgctgctccgata

SEQ ID NO: 1794 - DNA, 16 bp, Artificial sequence
  Synthetic oligonucleotide
ggctatagggctgata

SEQ ID NO: 1795 - DNA, 16 bp, Artificial sequence
  Synthetic oligonucleotide
aaatgcaccgctctgc

SEQ ID NO: 1796 - DNA, 16 bp, Artificial sequence
  Synthetic oligonucleotide
acagaataagacatcg

SEQ ID NO: 1797 - DNA, 16 bp, Artificial sequence
  Synthetic oligonucleotide
agcaatcgcacatgcc

SEQ ID NO: 1798 - DNA, 16 bp, Artificial sequence
  Synthetic oligonucleotide
agtagatgccagaggg

SEQ ID NO: 1799 - DNA, 16 bp, Artificial sequence
  Synthetic oligonucleotide
ggctaagcatgaaggg

SEQ ID NO: 1800 - DNA, 16 bp, Artificial sequence
  Synthetic oligonucleotide
atctatctcagacatc

SEQ ID NO: 1801 - DNA, 16 bp, Artificial sequence
  Synthetic oligonucleotide
ccaaggtctgaacttt

SEQ ID NO: 1802 - DNA, 16 bp, Artificial sequence
  Synthetic oligonucleotide
aaccaaggtctgaact

SEQ ID NO: 1803 - DNA, 16 bp, Artificial sequence
  Synthetic oligonucleotide
caaccaaggtctgaac

SEQ ID NO: 1804 - DNA, 16 bp, Artificial sequence
  Synthetic oligonucleotide
gcaaccaaggtctgaa

SEQ ID NO: 1805 - DNA, 16 bp, Artificial sequence
  Synthetic oligonucleotide
tggcaaccaaggtctg

SEQ ID NO: 1806 - DNA, 16 bp, Artificial sequence
  Synthetic oligonucleotide
ctggcaaccaaggtct

SEQ ID NO: 1807 - DNA, 16 bp, Artificial sequence
  Synthetic oligonucleotide
gctggcaaccaaggtc

SEQ ID NO: 1808 - DNA, 16 bp, Artificial sequence
  Synthetic oligonucleotide
atgctggcaaccaagg

SEQ ID NO: 1809 - DNA, 16 bp, Artificial sequence
  Synthetic oligonucleotide
gaatttagccctgaca

SEQ ID NO: 1810 - DNA, 16 bp, Artificial sequence
  Synthetic oligonucleotide
agctaaacagggtttt

SEQ ID NO: 1811 - DNA, 16 bp, Artificial sequence
  Synthetic oligonucleotide
gtccaagggcagccgg

SEQ ID NO: 1812 - DNA, 16 bp, Artificial sequence
  Synthetic oligonucleotide
ccccaaaggcccttag

SEQ ID NO: 1813 - DNA, 16 bp, Artificial sequence
  Synthetic oligonucleotide
gtggacatcagtgagt

SEQ ID NO: 1814 - DNA, 16 bp, Artificial sequence
  Synthetic oligonucleotide
ctacaagtgagctgag

SEQ ID NO: 1815 - DNA, 16 bp, Artificial sequence
  Synthetic oligonucleotide
caaaacgggagcaggc

SEQ ID NO: 1816 - DNA, 16 bp, Artificial sequence
  Synthetic oligonucleotide
acaaaacgggagcagg

SEQ ID NO: 1817 - DNA, 16 bp, Artificial sequence
  Synthetic oligonucleotide
cacaaaacgggagcag

SEQ ID NO: 1818 - DNA, 16 bp, Artificial sequence
  Synthetic oligonucleotide
aaaaagggtccagtgg

SEQ ID NO: 1819 - DNA, 16 bp, Artificial sequence
  Synthetic oligonucleotide
tcattagtacgccagg

SEQ ID NO: 1820 - DNA, 16 bp, Artificial sequence
  Synthetic oligonucleotide
cccaactgtgctttcc

SEQ ID NO: 1821 - DNA, 16 bp, Artificial sequence
  Synthetic oligonucleotide
tcacacacggattttt

SEQ ID NO: 1822 - DNA, 16 bp, Artificial sequence
  Synthetic oligonucleotide
ttctgcattgcagtgg

SEQ ID NO: 1823 - DNA, 16 bp, Artificial sequence
  Synthetic oligonucleotide
gtaaaaagcatctggc

SEQ ID NO: 1824 - DNA, 16 bp, Artificial sequence
  Synthetic oligonucleotide
gccagagtcaccatca

SEQ ID NO: 1825 - DNA, 16 bp, Artificial sequence
  Synthetic oligonucleotide
tgccaaggtgaggtca

SEQ ID NO: 1826 - DNA, 16 bp, Artificial sequence
  Synthetic oligonucleotide
cgccagatctctcttg

SEQ ID NO: 1827 - DNA, 16 bp, Artificial sequence
  Synthetic oligonucleotide
tgcctaccattgcact

SEQ ID NO: 1828 - DNA, 16 bp, Artificial sequence
  Synthetic oligonucleotide
cgagaaggaggtagaa

SEQ ID NO: 1829 - DNA, 16 bp, Artificial sequence
  Synthetic oligonucleotide
aactacaccgagaagg

SEQ ID NO: 1830 - DNA, 16 bp, Artificial sequence
  Synthetic oligonucleotide
tccaaaactacaccga

SEQ ID NO: 1831 - DNA, 16 bp, Artificial sequence
  Synthetic oligonucleotide
atcaaacgagtatatt

SEQ ID NO: 1832 - DNA, 16 bp, Artificial sequence
  Synthetic oligonucleotide
tatcaaacgagtatat

SEQ ID NO: 1833 - DNA, 16 bp, Artificial sequence
  Synthetic oligonucleotide
agctaaaatccactat

SEQ ID NO: 1834 - DNA, 16 bp, Artificial sequence
  Synthetic oligonucleotide
caatagggaagagcta

SEQ ID NO: 1835 - DNA, 16 bp, Artificial sequence
  Synthetic oligonucleotide
gcaatagggaagagct

SEQ ID NO: 1836 - DNA, 16 bp, Artificial sequence
  Synthetic oligonucleotide
agcaatagggaagagc

SEQ ID NO: 1837 - DNA, 16 bp, Artificial sequence
  Synthetic oligonucleotide
atcaagactctgaata

SEQ ID NO: 1838 - DNA, 16 bp, Artificial sequence
  Synthetic oligonucleotide
ttcaaagataggtgag

SEQ ID NO: 1839 - DNA, 16 bp, Artificial sequence
  Synthetic oligonucleotide
cattaagtatttggag

SEQ ID NO: 1840 - DNA, 16 bp, Artificial sequence
  Synthetic oligonucleotide
aagagcaacattaagt

SEQ ID NO: 1841 - DNA, 16 bp, Artificial sequence
  Synthetic oligonucleotide
gcgaagagcaacatta

SEQ ID NO: 1842 - DNA, 16 bp, Artificial sequence
  Synthetic oligonucleotide
tgcgaatgcacatggc

SEQ ID NO: 1843 - DNA, 16 bp, Artificial sequence
  Synthetic oligonucleotide
acacagagggtgcgaa

SEQ ID NO: 1844 - DNA, 16 bp, Artificial sequence
  Synthetic oligonucleotide
caacacagagggtgcg

SEQ ID NO: 1845 - DNA, 16 bp, Artificial sequence
  Synthetic oligonucleotide
taacatgttactcaga

SEQ ID NO: 1846 - DNA, 16 bp, Artificial sequence
  Synthetic oligonucleotide
tcaagtatagagatgg

SEQ ID NO: 1847 - DNA, 16 bp, Artificial sequence
  Synthetic oligonucleotide
agtacctgattcagcg

SEQ ID NO: 1848 - DNA, 16 bp, Artificial sequence
  Synthetic oligonucleotide
tgccagtgaggattgc

SEQ ID NO: 1849 - DNA, 16 bp, Artificial sequence
  Synthetic oligonucleotide
aaaacaagtgctgctc

SEQ ID NO: 1850 - DNA, 16 bp, Artificial sequence
  Synthetic oligonucleotide
gaatcaagtacatttc

SEQ ID NO: 1851 - DNA, 16 bp, Artificial sequence
  Synthetic oligonucleotide
gtaatagtagcagcac

SEQ ID NO: 1852 - DNA, 16 bp, Artificial sequence
  Synthetic oligonucleotide
tgtaatagtagcagca

SEQ ID NO: 1853 - DNA, 16 bp, Artificial sequence
  Synthetic oligonucleotide
gtcttctgggtaaatg

SEQ ID NO: 1854 - DNA, 16 bp, Artificial sequence
  Synthetic oligonucleotide
aggcaatgcatacagt

SEQ ID NO: 1855 - DNA, 16 bp, Artificial sequence
  Synthetic oligonucleotide
gaacgataggccaggc

SEQ ID NO: 1856 - DNA, 16 bp, Artificial sequence
  Synthetic oligonucleotide
aagaagagaacgatag

SEQ ID NO: 1857 - DNA, 16 bp, Artificial sequence
  Synthetic oligonucleotide
gtttatgcaccatgtg

SEQ ID NO: 1858 - DNA, 16 bp, Artificial sequence
  Synthetic oligonucleotide
aaaacagcgaggagga

SEQ ID NO: 1859 - DNA, 16 bp, Artificial sequence
  Synthetic oligonucleotide
tgctagaaaacagcga

SEQ ID NO: 1860 - DNA, 16 bp, Artificial sequence
  Synthetic oligonucleotide
caggaacctactctcg

SEQ ID NO: 1861 - DNA, 16 bp, Artificial sequence
  Synthetic oligonucleotide
acaaggacaggaacct

SEQ ID NO: 1862 - DNA, 16 bp, Artificial sequence
  Synthetic oligonucleotide
ctacaaggacaggaac

SEQ ID NO: 1863 - DNA, 16 bp, Artificial sequence
  Synthetic oligonucleotide
ctagacactgacttcc

SEQ ID NO: 1864 - DNA, 16 bp, Artificial sequence
  Synthetic oligonucleotide
ggccagctggactttt

SEQ ID NO: 1865 - DNA, 16 bp, Artificial sequence
  Synthetic oligonucleotide
tactagggcacttaag

SEQ ID NO: 1866 - DNA, 16 bp, Artificial sequence
  Synthetic oligonucleotide
gatactagggcactta

SEQ ID NO: 1867 - DNA, 16 bp, Artificial sequence
  Synthetic oligonucleotide
accaagggtccctgcc

SEQ ID NO: 1868 - DNA, 16 bp, Artificial sequence
  Synthetic oligonucleotide
tacaaagtgtctggcg

SEQ ID NO: 1869 - DNA, 16 bp, Artificial sequence
  Synthetic oligonucleotide
atacaaagtgtctggc

SEQ ID NO: 1870 - DNA, 16 bp, Artificial sequence
  Synthetic oligonucleotide
gattaggagacaagcc

SEQ ID NO: 1871 - DNA, 16 bp, Artificial sequence
  Synthetic oligonucleotide
atccattctggacaac

SEQ ID NO: 1872 - DNA, 16 bp, Artificial sequence
  Synthetic oligonucleotide
cactagaggataggcg

SEQ ID NO: 1873 - DNA, 16 bp, Artificial sequence
  Synthetic oligonucleotide
gtaaagcagagtttgg

SEQ ID NO: 1874 - DNA, 16 bp, Artificial sequence
  Synthetic oligonucleotide
tgtaaagcagagtttg

SEQ ID NO: 1875 - DNA, 16 bp, Artificial sequence
  Synthetic oligonucleotide
gcaaagtgtaaagcag

SEQ ID NO: 1876 - DNA, 16 bp, Artificial sequence
  Synthetic oligonucleotide
ccataaaatcagccta

SEQ ID NO: 1877 - DNA, 16 bp, Artificial sequence
  Synthetic oligonucleotide
aaagaactcgggaggt

SEQ ID NO: 1878 - DNA, 16 bp, Artificial sequence
  Synthetic oligonucleotide
ttaagatcaagagatc

SEQ ID NO: 1879 - DNA, 16 bp, Artificial sequence
  Synthetic oligonucleotide
tcaagatgagctcccc

SEQ ID NO: 1880 - DNA, 16 bp, Artificial sequence
  Synthetic oligonucleotide
gtccatccagaccacg

SEQ ID NO: 1881 - DNA, 16 bp, Artificial sequence
  Synthetic oligonucleotide
ggacagtccatccaga

SEQ ID NO: 1882 - DNA, 16 bp, Artificial sequence
  Synthetic oligonucleotide
ggagacggcacggagc

SEQ ID NO: 1883 - DNA, 16 bp, Artificial sequence
  Synthetic oligonucleotide
acggagacggcacgga

SEQ ID NO: 1884 - DNA, 16 bp, Artificial sequence
  Synthetic oligonucleotide
accaagggccaacacc

SEQ ID NO: 1885 - DNA, 16 bp, Artificial sequence
  Synthetic oligonucleotide
acatactgcagcaggg

SEQ ID NO: 1886 - DNA, 16 bp, Artificial sequence
  Synthetic oligonucleotide
aatcaatgagtggacg

SEQ ID NO: 1887 - DNA, 16 bp, Artificial sequence
  Synthetic oligonucleotide
acgcagaaggcttgca

SEQ ID NO: 1888 - DNA, 16 bp, Artificial sequence
  Synthetic oligonucleotide
ccattctgagcactcc

SEQ ID NO: 1889 - DNA, 16 bp, Artificial sequence
  Synthetic oligonucleotide
tctaaaggaggctgtt

SEQ ID NO: 1890 - DNA, 16 bp, Artificial sequence
  Synthetic oligonucleotide
agcctaattttgcaat

SEQ ID NO: 1891 - DNA, 16 bp, Artificial sequence
  Synthetic oligonucleotide
ggccaacactcatctt

SEQ ID NO: 1892 - DNA, 16 bp, Artificial sequence
  Synthetic oligonucleotide
tgatatgcagtgacac

SEQ ID NO: 1893 - DNA, 16 bp, Artificial sequence
  Synthetic oligonucleotide
tcccacacggctcctg

SEQ ID NO: 1894 - DNA, 16 bp, Artificial sequence
  Synthetic oligonucleotide
gcacaacctgctctat

SEQ ID NO: 1895 - DNA, 16 bp, Artificial sequence
  Synthetic oligonucleotide
gagcacctgagtcagt

SEQ ID NO: 1896 - DNA, 16 bp, Artificial sequence
  Synthetic oligonucleotide
accaaccaagtcatgg

SEQ ID NO: 1897 - DNA, 16 bp, Artificial sequence
  Synthetic oligonucleotide
agctaagcagctgcac

SEQ ID NO: 1898 - DNA, 16 bp, Artificial sequence
  Synthetic oligonucleotide
ttacaggccaaaagcc

SEQ ID NO: 1899 - DNA, 16 bp, Artificial sequence
  Synthetic oligonucleotide
gaggaggcggtgtcct

SEQ ID NO: 1900 - DNA, 16 bp, Artificial sequence
  Synthetic oligonucleotide
cataaaagcactctgg

SEQ ID NO: 1901 - DNA, 16 bp, Artificial sequence
  Synthetic oligonucleotide
gagcataaaagcactc

SEQ ID NO: 1902 - DNA, 16 bp, Artificial sequence
  Synthetic oligonucleotide
gtcaaggctgtctgag

SEQ ID NO: 1903 - DNA, 16 bp, Artificial sequence
  Synthetic oligonucleotide
gctgaatcttgtgttt

SEQ ID NO: 1904 - DNA, 16 bp, Artificial sequence
  Synthetic oligonucleotide
cacaacaacacttcct

SEQ ID NO: 1905 - DNA, 16 bp, Artificial sequence
  Synthetic oligonucleotide
ctttagaggtgcagaa

SEQ ID NO: 1906 - DNA, 16 bp, Artificial sequence
  Synthetic oligonucleotide
atccactgaagcctct

SEQ ID NO: 1907 - DNA, 16 bp, Artificial sequence
  Synthetic oligonucleotide
cttaacaagtagtatt

SEQ ID NO: 1908 - DNA, 16 bp, Artificial sequence
  Synthetic oligonucleotide
ggcttaacaagtagta

SEQ ID NO: 1909 - DNA, 16 bp, Artificial sequence
  Synthetic oligonucleotide
ggcaactggttacaaa

SEQ ID NO: 1910 - DNA, 16 bp, Artificial sequence
  Synthetic oligonucleotide
tgcaaggcaactggtt

SEQ ID NO: 1911 - DNA, 16 bp, Artificial sequence
  Synthetic oligonucleotide
ctccatggtgagagtg

SEQ ID NO: 1912 - DNA, 16 bp, Artificial sequence
  Synthetic oligonucleotide
gctaaagcaagaaggc

SEQ ID NO: 1913 - DNA, 16 bp, Artificial sequence
  Synthetic oligonucleotide
agaaagaccgcccatg

SEQ ID NO: 1914 - DNA, 16 bp, Artificial sequence
  Synthetic oligonucleotide
gcggagacagaaggct

SEQ ID NO: 1915 - DNA, 16 bp, Artificial sequence
  Synthetic oligonucleotide
aagcatcggttaaggc

SEQ ID NO: 1916 - DNA, 16 bp, Artificial sequence
  Synthetic oligonucleotide
cccaagtggtgaggct

SEQ ID NO: 1917 - DNA, 16 bp, Artificial sequence
  Synthetic oligonucleotide
gttcaggcaggcggtt

SEQ ID NO: 1918 - DNA, 16 bp, Artificial sequence
  Synthetic oligonucleotide
aacaagagaccttgtc

SEQ ID NO: 1919 - DNA, 16 bp, Artificial sequence
  Synthetic oligonucleotide
gatcaggctactcagg

SEQ ID NO: 1920 - DNA, 16 bp, Artificial sequence
  Synthetic oligonucleotide
tcatagccaatataac

SEQ ID NO: 1921 - DNA, 16 bp, Artificial sequence
  Synthetic oligonucleotide
tatcacagggtgtgct

SEQ ID NO: 1922 - DNA, 16 bp, Artificial sequence
  Synthetic oligonucleotide
tcggaatgtactctta

SEQ ID NO: 1923 - DNA, 16 bp, Artificial sequence
  Synthetic oligonucleotide
gaattcgggttgaatc

SEQ ID NO: 1924 - DNA, 16 bp, Artificial sequence
  Synthetic oligonucleotide
gacaaagcacacctgg

SEQ ID NO: 1925 - DNA, 16 bp, Artificial sequence
  Synthetic oligonucleotide
ggacaaagcacacctg

SEQ ID NO: 1926 - DNA, 16 bp, Artificial sequence
  Synthetic oligonucleotide
cactaaactaatgaca

SEQ ID NO: 1927 - DNA, 16 bp, Artificial sequence
  Synthetic oligonucleotide
tagcactaaactaatg

SEQ ID NO: 1928 - DNA, 16 bp, Artificial sequence
  Synthetic oligonucleotide
gcatagcactaaacta

SEQ ID NO: 1929 - DNA, 16 bp, Artificial sequence
  Synthetic oligonucleotide
aggcatagcactaaac

SEQ ID NO: 1930 - DNA, 16 bp, Artificial sequence
  Synthetic oligonucleotide
agcaaaggcatagcac

SEQ ID NO: 1931 - DNA, 16 bp, Artificial sequence
  Synthetic oligonucleotide
accaaaccaggaccaa

SEQ ID NO: 1932 - DNA, 16 bp, Artificial sequence
  Synthetic oligonucleotide
gttaatgcttcacctg

SEQ ID NO: 1933 - DNA, 16 bp, Artificial sequence
  Synthetic oligonucleotide
ggttaatgcttcacct

SEQ ID NO: 1934 - DNA, 16 bp, Artificial sequence
  Synthetic oligonucleotide
gtaaagggtgtgcaca

SEQ ID NO: 1935 - DNA, 16 bp, Artificial sequence
  Synthetic oligonucleotide
aggcaagcacaagctg

SEQ ID NO: 1936 - DNA, 16 bp, Artificial sequence
  Synthetic oligonucleotide
ccttcataccccaact

SEQ ID NO: 1937 - DNA, 16 bp, Artificial sequence
  Synthetic oligonucleotide
tactgaagtacctggg

SEQ ID NO: 1938 - DNA, 16 bp, Artificial sequence
  Synthetic oligonucleotide
tcctaagcattcctaa

SEQ ID NO: 1939 - DNA, 16 bp, Artificial sequence
  Synthetic oligonucleotide
gtaggatgatcttgtt

SEQ ID NO: 1940 - DNA, 16 bp, Artificial sequence
  Synthetic oligonucleotide
gtaaaaaagtaggatg

SEQ ID NO: 1941 - DNA, 16 bp, Artificial sequence
  Synthetic oligonucleotide
ccttaaaaagagtctc

SEQ ID NO: 1942 - DNA, 16 bp, Artificial sequence
  Synthetic oligonucleotide
gctcatctaatggaca

SEQ ID NO: 1943 - DNA, 16 bp, Artificial sequence
  Synthetic oligonucleotide
ggcgagacagagtaag

SEQ ID NO: 1944 - DNA, 16 bp, Artificial sequence
  Synthetic oligonucleotide
tatactggacacggtg

SEQ ID NO: 1945 - DNA, 16 bp, Artificial sequence
  Synthetic oligonucleotide
atatactggacacggt

SEQ ID NO: 1946 - DNA, 16 bp, Artificial sequence
  Synthetic oligonucleotide
atatatactggacacg

SEQ ID NO: 1947 - DNA, 16 bp, Artificial sequence
  Synthetic oligonucleotide
gttttattggccgggt

SEQ ID NO: 1948 - DNA, 16 bp, Artificial sequence
  Synthetic oligonucleotide
agtcactgatcctaaa

SEQ ID NO: 1949 - DNA, 16 bp, Artificial sequence
  Synthetic oligonucleotide
caagaagtcactgatc

SEQ ID NO: 1950 - DNA, 16 bp, Artificial sequence
  Synthetic oligonucleotide
acaaaatgggttgagg

SEQ ID NO: 1951 - DNA, 16 bp, Artificial sequence
  Synthetic oligonucleotide
tacaaaatgggttgag

SEQ ID NO: 1952 - DNA, 16 bp, Artificial sequence
  Synthetic oligonucleotide
ggacaggactttgccc

SEQ ID NO: 1953 - DNA, 16 bp, Artificial sequence
  Synthetic oligonucleotide
ccacaattcaggtggc

SEQ ID NO: 1954 - DNA, 16 bp, Artificial sequence
  Synthetic oligonucleotide
ggaaaggtagccactt

SEQ ID NO: 1955 - DNA, 16 bp, Artificial sequence
  Synthetic oligonucleotide
gcccacttattcctcc

SEQ ID NO: 1956 - DNA, 16 bp, Artificial sequence
  Synthetic oligonucleotide
ccaaattcaagagctc

SEQ ID NO: 1957 - DNA, 16 bp, Artificial sequence
  Synthetic oligonucleotide
taccatttttcagcag

SEQ ID NO: 1958 - DNA, 16 bp, Artificial sequence
  Synthetic oligonucleotide
tcaaaacggaggtttc

SEQ ID NO: 1959 - DNA, 16 bp, Artificial sequence
  Synthetic oligonucleotide
gaccatcctatgagga

SEQ ID NO: 1960 - DNA, 16 bp, Artificial sequence
  Synthetic oligonucleotide
gaccagagacgggagg

SEQ ID NO: 1961 - DNA, 16 bp, Artificial sequence
  Synthetic oligonucleotide
gcctagaggtaggagc

SEQ ID NO: 1962 - DNA, 16 bp, Artificial sequence
  Synthetic oligonucleotide
ccacaagttcaggcct

SEQ ID NO: 1963 - DNA, 16 bp, Artificial sequence
  Synthetic oligonucleotide
tcaaagctgagtgtca

SEQ ID NO: 1964 - DNA, 16 bp, Artificial sequence
  Synthetic oligonucleotide
tgctagggacatcttc

SEQ ID NO: 1965 - DNA, 16 bp, Artificial sequence
  Synthetic oligonucleotide
gtatatatcagctcag

SEQ ID NO: 1966 - DNA, 16 bp, Artificial sequence
  Synthetic oligonucleotide
acataaggatgttgta

SEQ ID NO: 1967 - DNA, 16 bp, Artificial sequence
  Synthetic oligonucleotide
atccatgttcagtttc

SEQ ID NO: 1968 - DNA, 16 bp, Artificial sequence
  Synthetic oligonucleotide
cggaaaaagaagtccc

SEQ ID NO: 1969 - DNA, 16 bp, Artificial sequence
  Synthetic oligonucleotide
ttcaagcaaatcacac

SEQ ID NO: 1970 - DNA, 16 bp, Artificial sequence
  Synthetic oligonucleotide
tcagtatgcaccacca

SEQ ID NO: 1971 - DNA, 16 bp, Artificial sequence
  Synthetic oligonucleotide
aagcatgacatgacac

SEQ ID NO: 1972 - DNA, 16 bp, Artificial sequence
  Synthetic oligonucleotide
cagaatatttaactcg

SEQ ID NO: 1973 - DNA, 16 bp, Artificial sequence
  Synthetic oligonucleotide
gacaaaccaagcacat

SEQ ID NO: 1974 - DNA, 16 bp, Artificial sequence
  Synthetic oligonucleotide
gtggaacttgcctgac

SEQ ID NO: 1975 - DNA, 16 bp, Artificial sequence
  Synthetic oligonucleotide
tccaagagccctctta

SEQ ID NO: 1976 - DNA, 16 bp, Artificial sequence
  Synthetic oligonucleotide
cctatttgatcaggag

SEQ ID NO: 1977 - DNA, 16 bp, Artificial sequence
  Synthetic oligonucleotide
tgattcagtgccgccc

SEQ ID NO: 1978 - DNA, 16 bp, Artificial sequence
  Synthetic oligonucleotide
cccaaaaccctgattc

SEQ ID NO: 1979 - DNA, 16 bp, Artificial sequence
  Synthetic oligonucleotide
tcacgaggaagccatg

SEQ ID NO: 1980 - DNA, 16 bp, Artificial sequence
  Synthetic oligonucleotide
ggcgatggaagggcag

SEQ ID NO: 1981 - DNA, 16 bp, Artificial sequence
  Synthetic oligonucleotide
tttcattggccctggc

SEQ ID NO: 1982 - DNA, 16 bp, Artificial sequence
  Synthetic oligonucleotide
cagcaatttcattggc

SEQ ID NO: 1983 - DNA, 16 bp, Artificial sequence
  Synthetic oligonucleotide
taccttactggtacac

SEQ ID NO: 1984 - DNA, 16 bp, Artificial sequence
  Synthetic oligonucleotide
gccgagggagcaatac

SEQ ID NO: 1985 - DNA, 16 bp, Artificial sequence
  Synthetic oligonucleotide
tgccgagggagcaata

SEQ ID NO: 1986 - DNA, 16 bp, Artificial sequence
  Synthetic oligonucleotide
gaaaaggcaccagtgg

SEQ ID NO: 1987 - DNA, 16 bp, Artificial sequence
  Synthetic oligonucleotide
cacaaagcgatatggg

SEQ ID NO: 1988 - DNA, 16 bp, Artificial sequence
  Synthetic oligonucleotide
gtgcatctgtctggcc

SEQ ID NO: 1989 - DNA, 16 bp, Artificial sequence
  Synthetic oligonucleotide
tgctaggcttggtatc

SEQ ID NO: 1990 - DNA, 16 bp, Artificial sequence
  Synthetic oligonucleotide
cagcagttgacgcggg

SEQ ID NO: 1991 - DNA, 16 bp, Artificial sequence
  Synthetic oligonucleotide
ccggagctgagggaca

SEQ ID NO: 1992 - DNA, 16 bp, Artificial sequence
  Synthetic oligonucleotide
aaaaatgggctgcccc

SEQ ID NO: 1993 - DNA, 16 bp, Artificial sequence
  Synthetic oligonucleotide
ccaaaaatgggctgcc

SEQ ID NO: 1994 - DNA, 16 bp, Artificial sequence
  Synthetic oligonucleotide
gactaagtggatccaa

SEQ ID NO: 1995 - DNA, 16 bp, Artificial sequence
  Synthetic oligonucleotide
gcgcatagaggcactg

SEQ ID NO: 1996 - DNA, 16 bp, Artificial sequence
  Synthetic oligonucleotide
aaccaggcccgcggcg

SEQ ID NO: 1997 - DNA, 16 bp, Artificial sequence
  Synthetic oligonucleotide
gcgcaagcacagactg

SEQ ID NO: 1998 - DNA, 16 bp, Artificial sequence
  Synthetic oligonucleotide
gcagaaattccctggc

SEQ ID NO: 1999 - DNA, 16 bp, Artificial sequence
  Synthetic oligonucleotide
agcttaagcagcaaat

SEQ ID NO: 2000 - DNA, 16 bp, Artificial sequence
  Synthetic oligonucleotide
tttggactgttttccc

SEQ ID NO: 2001 - DNA, 16 bp, Artificial sequence
  Synthetic oligonucleotide
tgtttggactgttttc

SEQ ID NO: 2002 - DNA, 16 bp, Artificial sequence
  Synthetic oligonucleotide
ctgtttggactgtttt

SEQ ID NO: 2003 - DNA, 16 bp, Artificial sequence
  Synthetic oligonucleotide
cctgtttggactgttt

SEQ ID NO: 2004 - DNA, 16 bp, Artificial sequence
  Synthetic oligonucleotide
aacctgtttggactgt

SEQ ID NO: 2005 - DNA, 16 bp, Artificial sequence
  Synthetic oligonucleotide
caacctgtttggactg

SEQ ID NO: 2006 - DNA, 16 bp, Artificial sequence
  Synthetic oligonucleotide
tccaacctgtttggac

SEQ ID NO: 2007 - DNA, 16 bp, Artificial sequence
  Synthetic oligonucleotide
tttccaacctgtttgg

SEQ ID NO: 2008 - DNA, 16 bp, Artificial sequence
  Synthetic oligonucleotide
ttttccaacctgtttg

SEQ ID NO: 2009 - DNA, 16 bp, Artificial sequence
  Synthetic oligonucleotide
gttttccaacctgttt

SEQ ID NO: 2010 - DNA, 16 bp, Artificial sequence
  Synthetic oligonucleotide
atgtccatgacacctg

SEQ ID NO: 2011 - DNA, 16 bp, Artificial sequence
  Synthetic oligonucleotide
catgtccatgacacct

SEQ ID NO: 2012 - DNA, 16 bp, Artificial sequence
  Synthetic oligonucleotide
ttcatgtccatgacac

SEQ ID NO: 2013 - DNA, 16 bp, Artificial sequence
  Synthetic oligonucleotide
cattcatgtccatgac

SEQ ID NO: 2014 - DNA, 16 bp, Artificial sequence
  Synthetic oligonucleotide
aacattcatgtccatg

SEQ ID NO: 2015 - DNA, 16 bp, Artificial sequence
  Synthetic oligonucleotide
tacagaagggccacgg

SEQ ID NO: 2016 - DNA, 16 bp, Artificial sequence
  Synthetic oligonucleotide
ttacagaagggccacg

SEQ ID NO: 2017 - DNA, 16 bp, Artificial sequence
  Synthetic oligonucleotide
gattagtccatgcatg

SEQ ID NO: 2018 - DNA, 16 bp, Artificial sequence
  Synthetic oligonucleotide
acacacgcaggacagg

SEQ ID NO: 2019 - DNA, 16 bp, Artificial sequence
  Synthetic oligonucleotide
ggtcatgcggagggca

SEQ ID NO: 2020 - DNA, 16 bp, Artificial sequence
  Synthetic oligonucleotide
tgttaccttctcggca

SEQ ID NO: 2021 - DNA, 16 bp, Artificial sequence
  Synthetic oligonucleotide
gcggagatgagaacaa

SEQ ID NO: 2022 - DNA, 16 bp, Artificial sequence
  Synthetic oligonucleotide
ctggtaggcggaaggg

SEQ ID NO: 2023 - DNA, 16 bp, Artificial sequence
  Synthetic oligonucleotide
ctctaagtgacaactg

SEQ ID NO: 2024 - DNA, 16 bp, Artificial sequence
  Synthetic oligonucleotide
aacaaaggctgaccgc

SEQ ID NO: 2025 - DNA, 16 bp, Artificial sequence
  Synthetic oligonucleotide
gatgatgtgtttcctg

SEQ ID NO: 2026 - DNA, 16 bp, Artificial sequence
  Synthetic oligonucleotide
ggctatacagatgatg

SEQ ID NO: 2027 - DNA, 16 bp, Artificial sequence
  Synthetic oligonucleotide
aaccagacctcatgca

SEQ ID NO: 2028 - DNA, 16 bp, Artificial sequence
  Synthetic oligonucleotide
aacttaaccagacctc

SEQ ID NO: 2029 - DNA, 16 bp, Artificial sequence
  Synthetic oligonucleotide
cgccaaatgcccccac

SEQ ID NO: 2030 - DNA, 16 bp, Artificial sequence
  Synthetic oligonucleotide
gataggaactccttgc

SEQ ID NO: 2031 - DNA, 16 bp, Artificial sequence
  Synthetic oligonucleotide
tcgataggaactcctt

SEQ ID NO: 2032 - DNA, 16 bp, Artificial sequence
  Synthetic oligonucleotide
ctgaagggcctcgcca

SEQ ID NO: 2033 - DNA, 16 bp, Artificial sequence
  Synthetic oligonucleotide
tgccatgcagggcttc

SEQ ID NO: 2034 - DNA, 16 bp, Artificial sequence
  Synthetic oligonucleotide
gtggaccggagacagc

SEQ ID NO: 2035 - DNA, 16 bp, Artificial sequence
  Synthetic oligonucleotide
tagaaaatgcggaggg

SEQ ID NO: 2036 - DNA, 16 bp, Artificial sequence
  Synthetic oligonucleotide
cgggaagcaacatgaa

SEQ ID NO: 2037 - DNA, 16 bp, Artificial sequence
  Synthetic oligonucleotide
tggcacgggaagcaac

SEQ ID NO: 2038 - DNA, 16 bp, Artificial sequence
  Synthetic oligonucleotide
gaacaagcagagtggt

SEQ ID NO: 2039 - DNA, 16 bp, Artificial sequence
  Synthetic oligonucleotide
ggccagtacctggtcc

SEQ ID NO: 2040 - DNA, 16 bp, Artificial sequence
  Synthetic oligonucleotide
gaacagtacacttgac

SEQ ID NO: 2041 - DNA, 16 bp, Artificial sequence
  Synthetic oligonucleotide
gcacagaacagtacac

SEQ ID NO: 2042 - DNA, 16 bp, Artificial sequence
  Synthetic oligonucleotide
ggttgactacaaaggg

SEQ ID NO: 2043 - DNA, 16 bp, Artificial sequence
  Synthetic oligonucleotide
aggttgactacaaagg

SEQ ID NO: 2044 - DNA, 16 bp, Artificial sequence
  Synthetic oligonucleotide
agaggttgactacaaa

SEQ ID NO: 2045 - DNA, 16 bp, Artificial sequence
  Synthetic oligonucleotide
gagaggttgactacaa

SEQ ID NO: 2046 - DNA, 16 bp, Artificial sequence
  Synthetic oligonucleotide
ttgagaggttgactac

SEQ ID NO: 2047 - DNA, 16 bp, Artificial sequence
  Synthetic oligonucleotide
ttttgagaggttgact

SEQ ID NO: 2048 - DNA, 16 bp, Artificial sequence
  Synthetic oligonucleotide
gtttttgagaggttga

SEQ ID NO: 2049 - DNA, 16 bp, Artificial sequence
  Synthetic oligonucleotide
ggtttttgagaggttg

SEQ ID NO: 2050 - DNA, 16 bp, Artificial sequence
  Synthetic oligonucleotide
gggtttttgagaggtt

SEQ ID NO: 2051 - DNA, 16 bp, Artificial sequence
  Synthetic oligonucleotide
gtgggtttttgagagg

SEQ ID NO: 2052 - DNA, 16 bp, Artificial sequence
  Synthetic oligonucleotide
tgtgggtttttgagag

SEQ ID NO: 2053 - DNA, 16 bp, Artificial sequence
  Synthetic oligonucleotide
ctgtgggtttttgaga

SEQ ID NO: 2054 - DNA, 16 bp, Artificial sequence
  Synthetic oligonucleotide
gcctgtgggtttttga

SEQ ID NO: 2055 - DNA, 16 bp, Artificial sequence
  Synthetic oligonucleotide
ccataacttactgaag

SEQ ID NO: 2056 - DNA, 16 bp, Artificial sequence
  Synthetic oligonucleotide
gtaggatagggagcgg

SEQ ID NO: 2057 - DNA, 16 bp, Artificial sequence
  Synthetic oligonucleotide
tcccaaatgcagacgc

SEQ ID NO: 2058 - DNA, 16 bp, Artificial sequence
  Synthetic oligonucleotide
acaaacaacacgcttg

SEQ ID NO: 2059 - DNA, 16 bp, Artificial sequence
  Synthetic oligonucleotide
caacaaacaacacgct

SEQ ID NO: 2060 - DNA, 16 bp, Artificial sequence
  Synthetic oligonucleotide
aattaggtgggtaaag

SEQ ID NO: 2061 - DNA, 16 bp, Artificial sequence
  Synthetic oligonucleotide
gcctttgcaagaaagc

SEQ ID NO: 2062 - DNA, 16 bp, Artificial sequence
  Synthetic oligonucleotide
ggtttcaacaaacagt

SEQ ID NO: 2063 - DNA, 16 bp, Artificial sequence
  Synthetic oligonucleotide
aacaaagtgacatagc

SEQ ID NO: 2064 - DNA, 16 bp, Artificial sequence
  Synthetic oligonucleotide
ggagagggaccatttt

SEQ ID NO: 2065 - DNA, 16 bp, Artificial sequence
  Synthetic oligonucleotide
aatcaaaactgggcgc

SEQ ID NO: 2066 - DNA, 16 bp, Artificial sequence
  Synthetic oligonucleotide
agcaattggccaaatc

SEQ ID NO: 2067 - DNA, 16 bp, Artificial sequence
  Synthetic oligonucleotide
ggcataggtggactgg

SEQ ID NO: 2068 - DNA, 16 bp, Artificial sequence
  Synthetic oligonucleotide
agctacagcagctatg

SEQ ID NO: 2069 - DNA, 16 bp, Artificial sequence
  Synthetic oligonucleotide
cttaccaacagtaaca

SEQ ID NO: 2070 - DNA, 16 bp, Artificial sequence
  Synthetic oligonucleotide
ggctggtttagtaagg

SEQ ID NO: 2071 - DNA, 16 bp, Artificial sequence
  Synthetic oligonucleotide
gggcaaggcactcgga

SEQ ID NO: 2072 - DNA, 16 bp, Artificial sequence
  Synthetic oligonucleotide
gaataaagtagggcaa

SEQ ID NO: 2073 - DNA, 16 bp, Artificial sequence
  Synthetic oligonucleotide
cgtcactggactcccc

SEQ ID NO: 2074 - DNA, 16 bp, Artificial sequence
  Synthetic oligonucleotide
ccaggatgaagttggt

SEQ ID NO: 2075 - DNA, 16 bp, Artificial sequence
  Synthetic oligonucleotide
atcaagctagaaaggt

SEQ ID NO: 2076 - DNA, 16 bp, Artificial sequence
  Synthetic oligonucleotide
agctatcaagctagaa

SEQ ID NO: 2077 - DNA, 16 bp, Artificial sequence
  Synthetic oligonucleotide
ctcaagctatcaagct

SEQ ID NO: 2078 - DNA, 16 bp, Artificial sequence
  Synthetic oligonucleotide
ccaattatgaacacta

SEQ ID NO: 2079 - DNA, 16 bp, Artificial sequence
  Synthetic oligonucleotide
gttcaaagtgttgcat

SEQ ID NO: 2080 - DNA, 16 bp, Artificial sequence
  Synthetic oligonucleotide
agccactgccttgtat

SEQ ID NO: 2081 - DNA, 16 bp, Artificial sequence
  Synthetic oligonucleotide
aatcatagcctcaaac

SEQ ID NO: 2082 - DNA, 16 bp, Artificial sequence
  Synthetic oligonucleotide
gaacaatcatagcctc

SEQ ID NO: 2083 - DNA, 16 bp, Artificial sequence
  Synthetic oligonucleotide
aataatgtgcagttgt

SEQ ID NO: 2084 - DNA, 16 bp, Artificial sequence
  Synthetic oligonucleotide
ccccaaggtctggagt

SEQ ID NO: 2085 - DNA, 16 bp, Artificial sequence
  Synthetic oligonucleotide
tcccagacaggagaac

SEQ ID NO: 2086 - DNA, 16 bp, Artificial sequence
  Synthetic oligonucleotide
acctacttggcaaacc

SEQ ID NO: 2087 - DNA, 16 bp, Artificial sequence
  Synthetic oligonucleotide
ctctaaaagtacctac

SEQ ID NO: 2088 - DNA, 16 bp, Artificial sequence
  Synthetic oligonucleotide
cgacagagactgtctg

SEQ ID NO: 2089 - DNA, 16 bp, Artificial sequence
  Synthetic oligonucleotide
ctaaactaaccatggg

SEQ ID NO: 2090 - DNA, 16 bp, Artificial sequence
  Synthetic oligonucleotide
gaacatagcactgccc

SEQ ID NO: 2091 - DNA, 16 bp, Artificial sequence
  Synthetic oligonucleotide
ctgaacatagcactgc

SEQ ID NO: 2092 - DNA, 16 bp, Artificial sequence
  Synthetic oligonucleotide
tctgaacatagcactg

SEQ ID NO: 2093 - DNA, 16 bp, Artificial sequence
  Synthetic oligonucleotide
gcacactggtcgctaa

SEQ ID NO: 2094 - DNA, 16 bp, Artificial sequence
  Synthetic oligonucleotide
ttgaagctagggagac

SEQ ID NO: 2095 - DNA, 16 bp, Artificial sequence
  Synthetic oligonucleotide
acggaaggttctggtt

SEQ ID NO: 2096 - DNA, 16 bp, Artificial sequence
  Synthetic oligonucleotide
gcacactgaatcgaca

SEQ ID NO: 2097 - DNA, 16 bp, Artificial sequence
  Synthetic oligonucleotide
acgcacactgaatcga

SEQ ID NO: 2098 - DNA, 16 bp, Artificial sequence
  Synthetic oligonucleotide
tgcctgagaccacgca

SEQ ID NO: 2099 - DNA, 16 bp, Artificial sequence
  Synthetic oligonucleotide
taccagcggcaccacc

SEQ ID NO: 2100 - DNA, 16 bp, Artificial sequence
  Synthetic oligonucleotide
agcgagagggcatacc

SEQ ID NO: 2101 - DNA, 16 bp, Artificial sequence
  Synthetic oligonucleotide
cactacaccttaacgc

SEQ ID NO: 2102 - DNA, 16 bp, Artificial sequence
  Synthetic oligonucleotide
ctctagaggccctccc

SEQ ID NO: 2103 - DNA, 16 bp, Artificial sequence
  Synthetic oligonucleotide
caccgataaatgttgt

SEQ ID NO: 2104 - DNA, 16 bp, Artificial sequence
  Synthetic oligonucleotide
cagcacggaacagatc

SEQ ID NO: 2105 - DNA, 16 bp, Artificial sequence
  Synthetic oligonucleotide
agggacttcggctcat

SEQ ID NO: 2106 - DNA, 16 bp, Artificial sequence
  Synthetic oligonucleotide
gcaaaccaaagatggg

SEQ ID NO: 2107 - DNA, 16 bp, Artificial sequence
  Synthetic oligonucleotide
ggtaagtgggaaggcc

SEQ ID NO: 2108 - DNA, 16 bp, Artificial sequence
  Synthetic oligonucleotide
ccccgtagctcttcag

SEQ ID NO: 2109 - DNA, 16 bp, Artificial sequence
  Synthetic oligonucleotide
tttaaggactccacct

SEQ ID NO: 2110 - DNA, 16 bp, Artificial sequence
  Synthetic oligonucleotide
tggcatcacctgactt

SEQ ID NO: 2111 - DNA, 16 bp, Artificial sequence
  Synthetic oligonucleotide
atccaaaatcctcccc

SEQ ID NO: 2112 - DNA, 16 bp, Artificial sequence
  Synthetic oligonucleotide
tcaaatagcagcccac

SEQ ID NO: 2113 - DNA, 16 bp, Artificial sequence
  Synthetic oligonucleotide
cctaagggcctcctgg

SEQ ID NO: 2114 - DNA, 16 bp, Artificial sequence
  Synthetic oligonucleotide
cacaagaaggattttc

SEQ ID NO: 2115 - DNA, 16 bp, Artificial sequence
  Synthetic oligonucleotide
cagcaatcgacccacc

SEQ ID NO: 2116 - DNA, 16 bp, Artificial sequence
  Synthetic oligonucleotide
gctgagattacgcacc

SEQ ID NO: 2117 - DNA, 16 bp, Artificial sequence
  Synthetic oligonucleotide
cttatctgggctattt

SEQ ID NO: 2118 - DNA, 16 bp, Artificial sequence
  Synthetic oligonucleotide
tattatagggcttctt

SEQ ID NO: 2119 - DNA, 16 bp, Artificial sequence
  Synthetic oligonucleotide
gaaagtaggcttctgt

SEQ ID NO: 2120 - DNA, 16 bp, Artificial sequence
  Synthetic oligonucleotide
tgttacttatccatca

SEQ ID NO: 2121 - DNA, 16 bp, Artificial sequence
  Synthetic oligonucleotide
caacatatatctcctg

SEQ ID NO: 2122 - DNA, 16 bp, Artificial sequence
  Synthetic oligonucleotide
acaaatcccactatat

SEQ ID NO: 2123 - DNA, 16 bp, Artificial sequence
  Synthetic oligonucleotide
gcatagacaaatccca

SEQ ID NO: 2124 - DNA, 16 bp, Artificial sequence
  Synthetic oligonucleotide
cgacagggtgtgtttc

SEQ ID NO: 2125 - DNA, 16 bp, Artificial sequence
  Synthetic oligonucleotide
aaatttagaggacatc

SEQ ID NO: 2126 - DNA, 16 bp, Artificial sequence
  Synthetic oligonucleotide
agccatccagtcttag

SEQ ID NO: 2127 - DNA, 16 bp, Artificial sequence
  Synthetic oligonucleotide
ctcaagtagttcccct

SEQ ID NO: 2128 - DNA, 16 bp, Artificial sequence
  Synthetic oligonucleotide
cactagaatcccggag

SEQ ID NO: 2129 - DNA, 16 bp, Artificial sequence
  Synthetic oligonucleotide
acttactaaagcgcag

SEQ ID NO: 2130 - DNA, 16 bp, Artificial sequence
  Synthetic oligonucleotide
agtaaatgtatctggt

SEQ ID NO: 2131 - DNA, 16 bp, Artificial sequence
  Synthetic oligonucleotide
gcgcaagggaaacggc

SEQ ID NO: 2132 - DNA, 16 bp, Artificial sequence
  Synthetic oligonucleotide
tgagcagccacaggta

SEQ ID NO: 2133 - DNA, 16 bp, Artificial sequence
  Synthetic oligonucleotide
agtgagcagccacagg

SEQ ID NO: 2134 - DNA, 16 bp, Artificial sequence
  Synthetic oligonucleotide
aagtgagcagccacag

SEQ ID NO: 2135 - DNA, 16 bp, Artificial sequence
  Synthetic oligonucleotide
caagtgagcagccaca

SEQ ID NO: 2136 - DNA, 16 bp, Artificial sequence
  Synthetic oligonucleotide
accaagtgagcagcca

SEQ ID NO: 2137 - DNA, 16 bp, Artificial sequence
  Synthetic oligonucleotide
ggaccaagtgagcagc

SEQ ID NO: 2138 - DNA, 16 bp, Artificial sequence
  Synthetic oligonucleotide
gcgaatgtggccgttc

SEQ ID NO: 2139 - DNA, 16 bp, Artificial sequence
  Synthetic oligonucleotide
gaacagacagggttca

SEQ ID NO: 2140 - DNA, 16 bp, Artificial sequence
  Synthetic oligonucleotide
cgggagactgcagagg

SEQ ID NO: 2141 - DNA, 16 bp, Artificial sequence
  Synthetic oligonucleotide
agcagatggcctggta

SEQ ID NO: 2142 - DNA, 16 bp, Artificial sequence
  Synthetic oligonucleotide
acatagggccttctgg

SEQ ID NO: 2143 - DNA, 16 bp, Artificial sequence
  Synthetic oligonucleotide
agccaagagtcaagtt

SEQ ID NO: 2144 - DNA, 16 bp, Artificial sequence
  Synthetic oligonucleotide
catgagcccaccactc

SEQ ID NO: 2145 - DNA, 16 bp, Artificial sequence
  Synthetic oligonucleotide
ctcctaacatgctaga

SEQ ID NO: 2146 - DNA, 16 bp, Artificial sequence
  Synthetic oligonucleotide
cgctcaagggaaaaat

SEQ ID NO: 2147 - DNA, 16 bp, Artificial sequence
  Synthetic oligonucleotide
tcccaagctcccctga

SEQ ID NO: 2148 - DNA, 16 bp, Artificial sequence
  Synthetic oligonucleotide
gatacagccgttcata

SEQ ID NO: 2149 - DNA, 16 bp, Artificial sequence
  Synthetic oligonucleotide
taataaggtactgaag

SEQ ID NO: 2150 - DNA, 16 bp, Artificial sequence
  Synthetic oligonucleotide
acgaagctaggaggcg

SEQ ID NO: 2151 - DNA, 16 bp, Artificial sequence
  Synthetic oligonucleotide
cacgaagctaggaggc

SEQ ID NO: 2152 - DNA, 16 bp, Artificial sequence
  Synthetic oligonucleotide
gcatgataatcccagc

SEQ ID NO: 2153 - DNA, 16 bp, Artificial sequence
  Synthetic oligonucleotide
agccgcccaggccaga

SEQ ID NO: 2154 - DNA, 16 bp, Artificial sequence
  Synthetic oligonucleotide
gcagaaattttgcgaa

SEQ ID NO: 2155 - DNA, 16 bp, Artificial sequence
  Synthetic oligonucleotide
aggcagaaattttgcg

SEQ ID NO: 2156 - DNA, 16 bp, Artificial sequence
  Synthetic oligonucleotide
ggtggagtccccgccc

SEQ ID NO: 2157 - DNA, 16 bp, Artificial sequence
  Synthetic oligonucleotide
gtgcaaggtacatggt

SEQ ID NO: 2158 - DNA, 16 bp, Artificial sequence
  Synthetic oligonucleotide
cgcaaaaataaatcat

SEQ ID NO: 2159 - DNA, 16 bp, Artificial sequence
  Synthetic oligonucleotide
gcgcaaaaataaatca

SEQ ID NO: 2160 - DNA, 16 bp, Artificial sequence
  Synthetic oligonucleotide
atgtattacctacggc

SEQ ID NO: 2161 - DNA, 16 bp, Artificial sequence
  Synthetic oligonucleotide
catattcatggtgtta

SEQ ID NO: 2162 - DNA, 16 bp, Artificial sequence
  Synthetic oligonucleotide
agagatggaagggacg

SEQ ID NO: 2163 - DNA, 16 bp, Artificial sequence
  Synthetic oligonucleotide
ccacactaagcatgta

SEQ ID NO: 2164 - DNA, 16 bp, Artificial sequence
  Synthetic oligonucleotide
tctaatgtttgctacc

SEQ ID NO: 2165 - DNA, 16 bp, Artificial sequence
  Synthetic oligonucleotide
ctctaatgtttgctac

SEQ ID NO: 2166 - DNA, 16 bp, Artificial sequence
  Synthetic oligonucleotide
accactagattctcta

SEQ ID NO: 2167 - DNA, 16 bp, Artificial sequence
  Synthetic oligonucleotide
gaacagggaatattag

SEQ ID NO: 2168 - DNA, 16 bp, Artificial sequence
  Synthetic oligonucleotide
ttatacccagggcaac

SEQ ID NO: 2169 - DNA, 16 bp, Artificial sequence
  Synthetic oligonucleotide
taagtatttgccatcc

SEQ ID NO: 2170 - DNA, 16 bp, Artificial sequence
  Synthetic oligonucleotide
gcttaagcgagatctt

SEQ ID NO: 2171 - DNA, 16 bp, Artificial sequence
  Synthetic oligonucleotide
gaattctggtctggct

SEQ ID NO: 2172 - DNA, 16 bp, Artificial sequence
  Synthetic oligonucleotide
cataggagatagaagg

SEQ ID NO: 2173 - DNA, 16 bp, Artificial sequence
  Synthetic oligonucleotide
tgcataggagatagaa

SEQ ID NO: 2174 - DNA, 16 bp, Artificial sequence
  Synthetic oligonucleotide
cacaagagggcaagat

SEQ ID NO: 2175 - DNA, 16 bp, Artificial sequence
  Synthetic oligonucleotide
tgctagatcaactagc

SEQ ID NO: 2176 - DNA, 16 bp, Artificial sequence
  Synthetic oligonucleotide
gcaaagagtgctagat

SEQ ID NO: 2177 - DNA, 16 bp, Artificial sequence
  Synthetic oligonucleotide
aggcaaagagtgctag

SEQ ID NO: 2178 - DNA, 16 bp, Artificial sequence
  Synthetic oligonucleotide
gcacaaggcaaagagt

SEQ ID NO: 2179 - DNA, 16 bp, Artificial sequence
  Synthetic oligonucleotide
tgctagaggagcggca

SEQ ID NO: 2180 - DNA, 16 bp, Artificial sequence
  Synthetic oligonucleotide
ctatagaacaggagtg

SEQ ID NO: 2181 - DNA, 16 bp, Artificial sequence
  Synthetic oligonucleotide
tgctatagaacaggag

SEQ ID NO: 2182 - DNA, 16 bp, Artificial sequence
  Synthetic oligonucleotide
agccacatctgctata

SEQ ID NO: 2183 - DNA, 16 bp, Artificial sequence
  Synthetic oligonucleotide
ccttaatcacttagcc

SEQ ID NO: 2184 - DNA, 16 bp, Artificial sequence
  Synthetic oligonucleotide
tatcatatagggagaa

SEQ ID NO: 2185 - DNA, 16 bp, Artificial sequence
  Synthetic oligonucleotide
gcatagagaagagggt

SEQ ID NO: 2186 - DNA, 16 bp, Artificial sequence
  Synthetic oligonucleotide
gacaagaggcagcatc

SEQ ID NO: 2187 - DNA, 16 bp, Artificial sequence
  Synthetic oligonucleotide
tcacaggccaaggata

SEQ ID NO: 2188 - DNA, 16 bp, Artificial sequence
  Synthetic oligonucleotide
tggcaggaaacggtgc

SEQ ID NO: 2189 - DNA, 16 bp, Artificial sequence
  Synthetic oligonucleotide
gcaaatatgattcatc

SEQ ID NO: 2190 - DNA, 16 bp, Artificial sequence
  Synthetic oligonucleotide
aaggaggtgttaccca

SEQ ID NO: 2191 - DNA, 16 bp, Artificial sequence
  Synthetic oligonucleotide
ctatgagtagcaggct

SEQ ID NO: 2192 - DNA, 16 bp, Artificial sequence
  Synthetic oligonucleotide
gtccaagtgtaagagc

SEQ ID NO: 2193 - DNA, 16 bp, Artificial sequence
  Synthetic oligonucleotide
gcaaaagggagcccct

SEQ ID NO: 2194 - DNA, 16 bp, Artificial sequence
  Synthetic oligonucleotide
agcaaaagggagcccc

SEQ ID NO: 2195 - DNA, 16 bp, Artificial sequence
  Synthetic oligonucleotide
tgccagaagagccccg

SEQ ID NO: 2196 - DNA, 16 bp, Artificial sequence
  Synthetic oligonucleotide
ctacaagaaagaccct

SEQ ID NO: 2197 - DNA, 16 bp, Artificial sequence
  Synthetic oligonucleotide
taggatcggctcagct

SEQ ID NO: 2198 - DNA, 16 bp, Artificial sequence
  Synthetic oligonucleotide
tggcataggatcggct

SEQ ID NO: 2199 - DNA, 16 bp, Artificial sequence
  Synthetic oligonucleotide
gaacacatgaggaacc

SEQ ID NO: 2200 - DNA, 16 bp, Artificial sequence
  Synthetic oligonucleotide
gtacaagggagaagca

SEQ ID NO: 2201 - DNA, 16 bp, Artificial sequence
  Synthetic oligonucleotide
ggccacgctcatgacg

SEQ ID NO: 2202 - DNA, 16 bp, Artificial sequence
  Synthetic oligonucleotide
gtagagatgggaacca

SEQ ID NO: 2203 - DNA, 16 bp, Artificial sequence
  Synthetic oligonucleotide
aagcagggatcctctg

SEQ ID NO: 2204 - DNA, 16 bp, Artificial sequence
  Synthetic oligonucleotide
gcggtatgggtggcag

SEQ ID NO: 2205 - DNA, 16 bp, Artificial sequence
  Synthetic oligonucleotide
ggctagggtgcacagt

SEQ ID NO: 2206 - DNA, 16 bp, Artificial sequence
  Synthetic oligonucleotide
cttagaaggaagtagg

SEQ ID NO: 2207 - DNA, 16 bp, Artificial sequence
  Synthetic oligonucleotide
ccgttagccatccacc

SEQ ID NO: 2208 - DNA, 16 bp, Artificial sequence
  Synthetic oligonucleotide
ccctagggagctgcaa

SEQ ID NO: 2209 - DNA, 16 bp, Artificial sequence
  Synthetic oligonucleotide
ccacacgggttcagag

SEQ ID NO: 2210 - DNA, 16 bp, Artificial sequence
  Synthetic oligonucleotide
gcacaccaagccttgg

SEQ ID NO: 2211 - DNA, 16 bp, Artificial sequence
  Synthetic oligonucleotide
agggatgtgcccgcac

SEQ ID NO: 2212 - DNA, 16 bp, Artificial sequence
  Synthetic oligonucleotide
tgacaaccaggtgagg

SEQ ID NO: 2213 - DNA, 16 bp, Artificial sequence
  Synthetic oligonucleotide
tgggaatgcctccatt

SEQ ID NO: 2214 - DNA, 16 bp, Artificial sequence
  Synthetic oligonucleotide
agcccctgtgaggtca

SEQ ID NO: 2215 - DNA, 16 bp, Artificial sequence
  Synthetic oligonucleotide
gtacagacttatccct

SEQ ID NO: 2216 - DNA, 16 bp, Artificial sequence
  Synthetic oligonucleotide
gggtacagacttatcc

SEQ ID NO: 2217 - DNA, 16 bp, Artificial sequence
  Synthetic oligonucleotide
ggctaaagagtaccca

SEQ ID NO: 2218 - DNA, 16 bp, Artificial sequence
  Synthetic oligonucleotide
ggtggctaaagagtac

SEQ ID NO: 2219 - DNA, 16 bp, Artificial sequence
  Synthetic oligonucleotide
gactaccccgacccac

SEQ ID NO: 2220 - DNA, 16 bp, Artificial sequence
  Synthetic oligonucleotide
gcacggcacggcagga

SEQ ID NO: 2221 - DNA, 16 bp, Artificial sequence
  Synthetic oligonucleotide
acgcacagggcggcct

SEQ ID NO: 2222 - DNA, 16 bp, Artificial sequence
  Synthetic oligonucleotide
aggcacgcacagggcg

SEQ ID NO: 2223 - DNA, 16 bp, Artificial sequence
  Synthetic oligonucleotide
ctaacggcaggcagcc

SEQ ID NO: 2224 - DNA, 16 bp, Artificial sequence
  Synthetic oligonucleotide
catcagggtttcaggc

SEQ ID NO: 2225 - DNA, 16 bp, Artificial sequence
  Synthetic oligonucleotide
ggctagggtcaaaggt

SEQ ID NO: 2226 - DNA, 16 bp, Artificial sequence
  Synthetic oligonucleotide
gcccatgggaggagtc

SEQ ID NO: 2227 - DNA, 16 bp, Artificial sequence
  Synthetic oligonucleotide
gaaaccaacatgaggc

SEQ ID NO: 2228 - DNA, 16 bp, Artificial sequence
  Synthetic oligonucleotide
cgcaatagagacacct

SEQ ID NO: 2229 - DNA, 16 bp, Artificial sequence
  Synthetic oligonucleotide
gaacctcgctccgtgc

SEQ ID NO: 2230 - DNA, 16 bp, Artificial sequence
  Synthetic oligonucleotide
agtgactgagttctgc

SEQ ID NO: 2231 - DNA, 16 bp, Artificial sequence
  Synthetic oligonucleotide
ggttacggttgttttt

SEQ ID NO: 2232 - DNA, 16 bp, Artificial sequence
  Synthetic oligonucleotide
gtacaatgtaagcctt

SEQ ID NO: 2233 - DNA, 16 bp, Artificial sequence
  Synthetic oligonucleotide
tgctagtgactccatc

SEQ ID NO: 2234 - DNA, 16 bp, Artificial sequence
  Synthetic oligonucleotide
agtgatggaaccccgg

SEQ ID NO: 2235 - DNA, 16 bp, Artificial sequence
  Synthetic oligonucleotide
cgcagatagaaaaact

SEQ ID NO: 2236 - DNA, 16 bp, Artificial sequence
  Synthetic oligonucleotide
tcgcagatagaaaaac

SEQ ID NO: 2237 - DNA, 16 bp, Artificial sequence
  Synthetic oligonucleotide
gcacactgtggccaag

SEQ ID NO: 2238 - DNA, 16 bp, Artificial sequence
  Synthetic oligonucleotide
agtgaacgagtccctc

SEQ ID NO: 2239 - DNA, 16 bp, Artificial sequence
  Synthetic oligonucleotide
ttctacataggaccat

SEQ ID NO: 2240 - DNA, 16 bp, Artificial sequence
  Synthetic oligonucleotide
aaacatcacagggacc

SEQ ID NO: 2241 - DNA, 16 bp, Artificial sequence
  Synthetic oligonucleotide
tcagaagagaggacct

SEQ ID NO: 2242 - DNA, 16 bp, Artificial sequence
  Synthetic oligonucleotide
agacacagggtaatgc

SEQ ID NO: 2243 - DNA, 16 bp, Artificial sequence
  Synthetic oligonucleotide
caacaatgcaacaacg

SEQ ID NO: 2244 - DNA, 16 bp, Artificial sequence
  Synthetic oligonucleotide
cgccagattaattttg

SEQ ID NO: 2245 - DNA, 16 bp, Artificial sequence
  Synthetic oligonucleotide
aacaattgtctggtgt

SEQ ID NO: 2246 - DNA, 16 bp, Artificial sequence
  Synthetic oligonucleotide
caacaattgtctggtg

SEQ ID NO: 2247 - DNA, 16 bp, Artificial sequence
  Synthetic oligonucleotide
taacaacaattgtctg

SEQ ID NO: 2248 - DNA, 16 bp, Artificial sequence
  Synthetic oligonucleotide
taagactatagttaac

SEQ ID NO: 2249 - DNA, 16 bp, Artificial sequence
  Synthetic oligonucleotide
caacagaagagtaggg

SEQ ID NO: 2250 - DNA, 16 bp, Artificial sequence
  Synthetic oligonucleotide
gttcaacagaagagta

SEQ ID NO: 2251 - DNA, 16 bp, Artificial sequence
  Synthetic oligonucleotide
gataaatactagaggc

SEQ ID NO: 2252 - DNA, 16 bp, Artificial sequence
  Synthetic oligonucleotide
gatcagggccatagaa

SEQ ID NO: 2253 - DNA, 16 bp, Artificial sequence
  Synthetic oligonucleotide
caagaaacgggttgat

SEQ ID NO: 2254 - DNA, 16 bp, Artificial sequence
  Synthetic oligonucleotide
aattaagcaagaaacg

SEQ ID NO: 2255 - DNA, 16 bp, Artificial sequence
  Synthetic oligonucleotide
caacaagctatcacac

SEQ ID NO: 2256 - DNA, 16 bp, Artificial sequence
  Synthetic oligonucleotide
ctggaccgcatcagag

SEQ ID NO: 2257 - DNA, 16 bp, Artificial sequence
  Synthetic oligonucleotide
ttgaaagccaacctgg

SEQ ID NO: 2258 - DNA, 16 bp, Artificial sequence
  Synthetic oligonucleotide
taacacagccatggct

SEQ ID NO: 2259 - DNA, 16 bp, Artificial sequence
  Synthetic oligonucleotide
ccacataacacagcca

SEQ ID NO: 2260 - DNA, 16 bp, Artificial sequence
  Synthetic oligonucleotide
ttgcagcacagggtca

SEQ ID NO: 2261 - DNA, 16 bp, Artificial sequence
  Synthetic oligonucleotide
ggcaacaggagacgcg

SEQ ID NO: 2262 - DNA, 16 bp, Artificial sequence
  Synthetic oligonucleotide
agaggctacatggtga

SEQ ID NO: 2263 - DNA, 16 bp, Artificial sequence
  Synthetic oligonucleotide
gaaacaaccaatatcc

SEQ ID NO: 2264 - DNA, 16 bp, Artificial sequence
  Synthetic oligonucleotide
cacgaagggttgacac

SEQ ID NO: 2265 - DNA, 16 bp, Artificial sequence
  Synthetic oligonucleotide
ggccagagtcctgact

SEQ ID NO: 2266 - DNA, 16 bp, Artificial sequence
  Synthetic oligonucleotide
gttaccaggacaaaac

SEQ ID NO: 2267 - DNA, 16 bp, Artificial sequence
  Synthetic oligonucleotide
tgccatcccagggacc

SEQ ID NO: 2268 - DNA, 16 bp, Artificial sequence
  Synthetic oligonucleotide
ctacagagcattcccc

SEQ ID NO: 2269 - DNA, 16 bp, Artificial sequence
  Synthetic oligonucleotide
tgccagcaagtcccca

SEQ ID NO: 2270 - DNA, 16 bp, Artificial sequence
  Synthetic oligonucleotide
gccaagaggcccgcct

SEQ ID NO: 2271 - DNA, 16 bp, Artificial sequence
  Synthetic oligonucleotide
acccgaatagcaagcg

SEQ ID NO: 2272 - DNA, 16 bp, Artificial sequence
  Synthetic oligonucleotide
gagcatgggcccgcag

SEQ ID NO: 2273 - DNA, 16 bp, Artificial sequence
  Synthetic oligonucleotide
gatgatcctttcaccc

SEQ ID NO: 2274 - DNA, 16 bp, Artificial sequence
  Synthetic oligonucleotide
caccaccctgggttta

SEQ ID NO: 2275 - DNA, 16 bp, Artificial sequence
  Synthetic oligonucleotide
gcagaccacgcctggc

SEQ ID NO: 2276 - DNA, 16 bp, Artificial sequence
  Synthetic oligonucleotide
tgcaaggcggaaagag

SEQ ID NO: 2277 - DNA, 16 bp, Artificial sequence
  Synthetic oligonucleotide
ggcattcccacccagg

SEQ ID NO: 2278 - DNA, 16 bp, Artificial sequence
  Synthetic oligonucleotide
gaaaactagacttgca

SEQ ID NO: 2279 - DNA, 16 bp, Artificial sequence
  Synthetic oligonucleotide
ctgaaaactagacttg

SEQ ID NO: 2280 - DNA, 16 bp, Artificial sequence
  Synthetic oligonucleotide
gaaaaacacgaagggc

SEQ ID NO: 2281 - DNA, 16 bp, Artificial sequence
  Synthetic oligonucleotide
tcattacggccggcgc

SEQ ID NO: 2282 - DNA, 16 bp, Artificial sequence
  Synthetic oligonucleotide
ctaacttgggtggtgg

SEQ ID NO: 2283 - DNA, 16 bp, Artificial sequence
  Synthetic oligonucleotide
agatattgatgtcttg

SEQ ID NO: 2284 - DNA, 16 bp, Artificial sequence
  Synthetic oligonucleotide
gcagagggagccccga

SEQ ID NO: 2285 - DNA, 16 bp, Artificial sequence
  Synthetic oligonucleotide
tcgcatagaagattcg

SEQ ID NO: 2286 - DNA, 16 bp, Artificial sequence
  Synthetic oligonucleotide
cggcaggtgagtgtca

SEQ ID NO: 2287 - DNA, 16 bp, Artificial sequence
  Synthetic oligonucleotide
gactacctgttcagga

SEQ ID NO: 2288 - DNA, 16 bp, Artificial sequence
  Synthetic oligonucleotide
gaagagtggtggtttc

SEQ ID NO: 2289 - DNA, 16 bp, Artificial sequence
  Synthetic oligonucleotide
tgcgagccggccccag

SEQ ID NO: 2290 - DNA, 16 bp, Artificial sequence
  Synthetic oligonucleotide
cacgatcccaaaccct

SEQ ID NO: 2291 - DNA, 16 bp, Artificial sequence
  Synthetic oligonucleotide
tgccggcacgcacgcg

SEQ ID NO: 2292 - DNA, 16 bp, Artificial sequence
  Synthetic oligonucleotide
cagcagggccaagtaa

SEQ ID NO: 2293 - DNA, 16 bp, Artificial sequence
  Synthetic oligonucleotide
ggtaacacagggcctg

SEQ ID NO: 2294 - DNA, 16 bp, Artificial sequence
  Synthetic oligonucleotide
gagcataggaagaggg

SEQ ID NO: 2295 - DNA, 16 bp, Artificial sequence
  Synthetic oligonucleotide
gcaaagaagtagggca

SEQ ID NO: 2296 - DNA, 16 bp, Artificial sequence
  Synthetic oligonucleotide
gattagcctgccaggc

SEQ ID NO: 2297 - DNA, 16 bp, Artificial sequence
  Synthetic oligonucleotide
cctcatctatccaagg

SEQ ID NO: 2298 - DNA, 16 bp, Artificial sequence
  Synthetic oligonucleotide
ggcacatgggctcagc

SEQ ID NO: 2299 - DNA, 16 bp, Artificial sequence
  Synthetic oligonucleotide
ctccaagttcaggagc

SEQ ID NO: 2300 - DNA, 16 bp, Artificial sequence
  Synthetic oligonucleotide
cgcaagccacagcagg

SEQ ID NO: 2301 - DNA, 16 bp, Artificial sequence
  Synthetic oligonucleotide
actcacccagtgatgt

SEQ ID NO: 2302 - DNA, 16 bp, Artificial sequence
  Synthetic oligonucleotide
gttcaggaagcaccaa

SEQ ID NO: 2303 - DNA, 16 bp, Artificial sequence
  Synthetic oligonucleotide
agccttactccctttc

SEQ ID NO: 2304 - DNA, 16 bp, Artificial sequence
  Synthetic oligonucleotide
cgctttaggacatctt

SEQ ID NO: 2305 - DNA, 16 bp, Artificial sequence
  Synthetic oligonucleotide
taggagtgagttacct

SEQ ID NO: 2306 - DNA, 16 bp, Artificial sequence
  Synthetic oligonucleotide
cacgaagtgaatggaa

SEQ ID NO: 2307 - DNA, 16 bp, Artificial sequence
  Synthetic oligonucleotide
acgcacaacacaactg

SEQ ID NO: 2308 - DNA, 16 bp, Artificial sequence
  Synthetic oligonucleotide
tgccactggactgact

SEQ ID NO: 2309 - DNA, 16 bp, Artificial sequence
  Synthetic oligonucleotide
gacctaggtgcctgac

SEQ ID NO: 2310 - DNA, 16 bp, Artificial sequence
  Synthetic oligonucleotide
actctacccgcaccct

SEQ ID NO: 2311 - DNA, 16 bp, Artificial sequence
  Synthetic oligonucleotide
ctccatgatgctccct

SEQ ID NO: 2312 - DNA, 16 bp, Artificial sequence
  Synthetic oligonucleotide
gtgtagcatgcgccac

SEQ ID NO: 2313 - DNA, 16 bp, Artificial sequence
  Synthetic oligonucleotide
gggaaaagagtcaccc

SEQ ID NO: 2314 - DNA, 16 bp, Artificial sequence
  Synthetic oligonucleotide
cttcaccccgagccat

SEQ ID NO: 2315 - DNA, 16 bp, Artificial sequence
  Synthetic oligonucleotide
cgggaagcatccctgg

SEQ ID NO: 2316 - DNA, 16 bp, Artificial sequence
  Synthetic oligonucleotide
cagcacgggaagcatc

SEQ ID NO: 2317 - DNA, 16 bp, Artificial sequence
  Synthetic oligonucleotide
tgcaagcacctgagcc

SEQ ID NO: 2318 - DNA, 16 bp, Artificial sequence
  Synthetic oligonucleotide
ccctatgggttctggc

SEQ ID NO: 2319 - DNA, 16 bp, Artificial sequence
  Synthetic oligonucleotide
tcacaattggtgcctt

SEQ ID NO: 2320 - DNA, 16 bp, Artificial sequence
  Synthetic oligonucleotide
ccccacctcggccaat

SEQ ID NO: 2321 - DNA, 16 bp, Artificial sequence
  Synthetic oligonucleotide
ctaaatggagctcttg

SEQ ID NO: 2322 - DNA, 16 bp, Artificial sequence
  Synthetic oligonucleotide
ggcctaaatggagctc

SEQ ID NO: 2323 - DNA, 16 bp, Artificial sequence
  Synthetic oligonucleotide
catcacactcctcgat

SEQ ID NO: 2324 - DNA, 16 bp, Artificial sequence
  Synthetic oligonucleotide
atgtactgtgagcttc

SEQ ID NO: 2325 - DNA, 16 bp, Artificial sequence
  Synthetic oligonucleotide
gctaatccctgactca

SEQ ID NO: 2326 - DNA, 16 bp, Artificial sequence
  Synthetic oligonucleotide
actcagctggagttgg

SEQ ID NO: 2327 - DNA, 16 bp, Artificial sequence
  Synthetic oligonucleotide
gacaaatgggtctcga

SEQ ID NO: 2328 - DNA, 16 bp, Artificial sequence
  Synthetic oligonucleotide
gcctagaagagctatg

SEQ ID NO: 2329 - DNA, 16 bp, Artificial sequence
  Synthetic oligonucleotide
ggcaagcctagaagag

SEQ ID NO: 2330 - DNA, 16 bp, Artificial sequence
  Synthetic oligonucleotide
aggcacacggctcagg

SEQ ID NO: 2331 - DNA, 16 bp, Artificial sequence
  Synthetic oligonucleotide
gtacaggaggcacacg

SEQ ID NO: 2332 - DNA, 16 bp, Artificial sequence
  Synthetic oligonucleotide
tactactctgggtttc

SEQ ID NO: 2333 - DNA, 16 bp, Artificial sequence
  Synthetic oligonucleotide
gaacatgcagggcctg

SEQ ID NO: 2334 - DNA, 16 bp, Artificial sequence
  Synthetic oligonucleotide
aagaagtagaagtcgg

SEQ ID NO: 2335 - DNA, 16 bp, Artificial sequence
  Synthetic oligonucleotide
ggatgaggttgtgtgg

SEQ ID NO: 2336 - DNA, 16 bp, Artificial sequence
  Synthetic oligonucleotide
acgcacattttcctgt

SEQ ID NO: 2337 - DNA, 16 bp, Artificial sequence
  Synthetic oligonucleotide
tgctaaacagtgcttg

SEQ ID NO: 2338 - DNA, 16 bp, Artificial sequence
  Synthetic oligonucleotide
aaagtttaggcatggt

SEQ ID NO: 2339 - DNA, 16 bp, Artificial sequence
  Synthetic oligonucleotide
cgtcaatactaaaata

SEQ ID NO: 2340 - DNA, 16 bp, Artificial sequence
  Synthetic oligonucleotide
gcccgaatgtgttttg

SEQ ID NO: 2341 - DNA, 16 bp, Artificial sequence
  Synthetic oligonucleotide
caccagaactttatta

SEQ ID NO: 2342 - DNA, 16 bp, Artificial sequence
  Synthetic oligonucleotide
ggcaagtgtctgagtt

SEQ ID NO: 2343 - DNA, 16 bp, Artificial sequence
  Synthetic oligonucleotide
tctgactgatcaggaa

SEQ ID NO: 2344 - DNA, 16 bp, Artificial sequence
  Synthetic oligonucleotide
gcacaagcttgaccct

SEQ ID NO: 2345 - DNA, 16 bp, Artificial sequence
  Synthetic oligonucleotide
gaaaatgacctgtcct

SEQ ID NO: 2346 - DNA, 16 bp, Artificial sequence
  Synthetic oligonucleotide
ccgtgagggaactttc

SEQ ID NO: 2347 - DNA, 16 bp, Artificial sequence
  Synthetic oligonucleotide
aagcaagtgggacccc

SEQ ID NO: 2348 - DNA, 16 bp, Artificial sequence
  Synthetic oligonucleotide
gaacaaagcaagtggg

SEQ ID NO: 2349 - DNA, 16 bp, Artificial sequence
  Synthetic oligonucleotide
ggccaagggtggccat

SEQ ID NO: 2350 - DNA, 16 bp, Artificial sequence
  Synthetic oligonucleotide
cggcaaggcattttaa

SEQ ID NO: 2351 - DNA, 16 bp, Artificial sequence
  Synthetic oligonucleotide
tttaagcgatctcctg

SEQ ID NO: 2352 - DNA, 16 bp, Artificial sequence
  Synthetic oligonucleotide
gtttaagcgatctcct

SEQ ID NO: 2353 - DNA, 16 bp, Artificial sequence
  Synthetic oligonucleotide
acccaaccttgggaca

SEQ ID NO: 2354 - DNA, 16 bp, Artificial sequence
  Synthetic oligonucleotide
cccaaaggatctgccc

SEQ ID NO: 2355 - DNA, 16 bp, Artificial sequence
  Synthetic oligonucleotide
tgcctgggtatgtttg

SEQ ID NO: 2356 - DNA, 16 bp, Artificial sequence
  Synthetic oligonucleotide
agataggcctgcttgc

SEQ ID NO: 2357 - DNA, 16 bp, Artificial sequence
  Synthetic oligonucleotide
caccagataggcctgc

SEQ ID NO: 2358 - DNA, 16 bp, Artificial sequence
  Synthetic oligonucleotide
actcacattgttgatc

SEQ ID NO: 2359 - DNA, 16 bp, Artificial sequence
  Synthetic oligonucleotide
ctctaggcttaccaca

SEQ ID NO: 2360 - DNA, 16 bp, Artificial sequence
  Synthetic oligonucleotide
gcctagggtgcctggc

SEQ ID NO: 2361 - DNA, 16 bp, Artificial sequence
  Synthetic oligonucleotide
tacaaacaggtatggc

SEQ ID NO: 2362 - DNA, 16 bp, Artificial sequence
  Synthetic oligonucleotide
ctacaaacaggtatgg

SEQ ID NO: 2363 - DNA, 16 bp, Artificial sequence
  Synthetic oligonucleotide
tcaaatttgttgttgc

SEQ ID NO: 2364 - DNA, 16 bp, Artificial sequence
  Synthetic oligonucleotide
ccaaagaggatggccg

SEQ ID NO: 2365 - DNA, 16 bp, Artificial sequence
  Synthetic oligonucleotide
agttagtggacttgat

SEQ ID NO: 2366 - DNA, 16 bp, Artificial sequence
  Synthetic oligonucleotide
ctgcagtgttcactcc

SEQ ID NO: 2367 - DNA, 16 bp, Artificial sequence
  Synthetic oligonucleotide
gcctaagttaattcag

SEQ ID NO: 2368 - DNA, 16 bp, Artificial sequence
  Synthetic oligonucleotide
gcaaccagggtaaacg

SEQ ID NO: 2369 - DNA, 16 bp, Artificial sequence
  Synthetic oligonucleotide
actgaagaggagccca

SEQ ID NO: 2370 - DNA, 16 bp, Artificial sequence
  Synthetic oligonucleotide
gccaaaggcctgatac

SEQ ID NO: 2371 - DNA, 16 bp, Artificial sequence
  Synthetic oligonucleotide
ggtttataaagcttcc

SEQ ID NO: 2372 - DNA, 16 bp, Artificial sequence
  Synthetic oligonucleotide
tcttacctcggtcttc

SEQ ID NO: 2373 - DNA, 16 bp, Artificial sequence
  Synthetic oligonucleotide
tgaaagaggttcctgc

SEQ ID NO: 2374 - DNA, 16 bp, Artificial sequence
  Synthetic oligonucleotide
gttgacattcatatac

SEQ ID NO: 2375 - DNA, 16 bp, Artificial sequence
  Synthetic oligonucleotide
tgagaatgggagcaac

SEQ ID NO: 2376 - DNA, 16 bp, Artificial sequence
  Synthetic oligonucleotide
gaacactgatcactac

SEQ ID NO: 2377 - DNA, 16 bp, Artificial sequence
  Synthetic oligonucleotide
aaacataccaggacac

SEQ ID NO: 2378 - DNA, 16 bp, Artificial sequence
  Synthetic oligonucleotide
tcctatcggtatatga

SEQ ID NO: 2379 - DNA, 16 bp, Artificial sequence
  Synthetic oligonucleotide
tcatagcagaagaacc

SEQ ID NO: 2380 - DNA, 16 bp, Artificial sequence
  Synthetic oligonucleotide
taaacttgcagggtca

SEQ ID NO: 2381 - DNA, 16 bp, Artificial sequence
  Synthetic oligonucleotide
ctaaaagtaaacttgc

SEQ ID NO: 2382 - DNA, 16 bp, Artificial sequence
  Synthetic oligonucleotide
tcccatctttggctgc

SEQ ID NO: 2383 - DNA, 16 bp, Artificial sequence
  Synthetic oligonucleotide
tcctactggatacaga

SEQ ID NO: 2384 - DNA, 16 bp, Artificial sequence
  Synthetic oligonucleotide
gccaatcctgttatat

SEQ ID NO: 2385 - DNA, 16 bp, Artificial sequence
  Synthetic oligonucleotide
gcagaataatcctgtt

SEQ ID NO: 2386 - DNA, 16 bp, Artificial sequence
  Synthetic oligonucleotide
tggcagaataatcctg

SEQ ID NO: 2387 - DNA, 16 bp, Artificial sequence
  Synthetic oligonucleotide
gttgacaccatgcttg

SEQ ID NO: 2388 - DNA, 16 bp, Artificial sequence
  Synthetic oligonucleotide
ccccagacttttttga

SEQ ID NO: 2389 - DNA, 16 bp, Artificial sequence
  Synthetic oligonucleotide
aaccaggcttccggac

SEQ ID NO: 2390 - DNA, 16 bp, Artificial sequence
  Synthetic oligonucleotide
agctgtagggctggct

SEQ ID NO: 2391 - DNA, 16 bp, Artificial sequence
  Synthetic oligonucleotide
tctggccacgccttgc

SEQ ID NO: 2392 - DNA, 16 bp, Artificial sequence
  Synthetic oligonucleotide
ccttaaggaactccat

SEQ ID NO: 2393 - DNA, 16 bp, Artificial sequence
  Synthetic oligonucleotide
cctaatatctctaggg

SEQ ID NO: 2394 - DNA, 16 bp, Artificial sequence
  Synthetic oligonucleotide
gcgcagtgggatcctc

SEQ ID NO: 2395 - DNA, 16 bp, Artificial sequence
  Synthetic oligonucleotide
tgccagaacctgaggt

SEQ ID NO: 2396 - DNA, 16 bp, Artificial sequence
  Synthetic oligonucleotide
atacagatggagtagg

SEQ ID NO: 2397 - DNA, 16 bp, Artificial sequence
  Synthetic oligonucleotide
acaggaggagagaccc

SEQ ID NO: 2398 - DNA, 16 bp, Artificial sequence
  Synthetic oligonucleotide
ccaaatagggatgagg

SEQ ID NO: 2399 - DNA, 16 bp, Artificial sequence
  Synthetic oligonucleotide
tcgcaagccaaatagg

SEQ ID NO: 2400 - DNA, 16 bp, Artificial sequence
  Synthetic oligonucleotide
gaacaagcctcttggc

SEQ ID NO: 2401 - DNA, 16 bp, Artificial sequence
  Synthetic oligonucleotide
gcccagtgtgagggtt

SEQ ID NO: 2402 - DNA, 16 bp, Artificial sequence
  Synthetic oligonucleotide
catcaactcgcctgct

SEQ ID NO: 2403 - DNA, 16 bp, Artificial sequence
  Synthetic oligonucleotide
ccgggagcaagaggca

SEQ ID NO: 2404 - DNA, 16 bp, Artificial sequence
  Synthetic oligonucleotide
ccagatggcagacttc

SEQ ID NO: 2405 - DNA, 16 bp, Artificial sequence
  Synthetic oligonucleotide
agatatctagatggcc

SEQ ID NO: 2406 - DNA, 16 bp, Artificial sequence
  Synthetic oligonucleotide
tagatatctagatggc

SEQ ID NO: 2407 - DNA, 16 bp, Artificial sequence
  Synthetic oligonucleotide
atagatatctagatgg

SEQ ID NO: 2408 - DNA, 16 bp, Artificial sequence
  Synthetic oligonucleotide
ccaaatggtggtggca

SEQ ID NO: 2409 - DNA, 16 bp, Artificial sequence
  Synthetic oligonucleotide
ccaatttgtaggctgt

SEQ ID NO: 2410 - DNA, 16 bp, Artificial sequence
  Synthetic oligonucleotide
acagatgggcacaccg

SEQ ID NO: 2411 - DNA, 16 bp, Artificial sequence
  Synthetic oligonucleotide
acaaatgagtagttcc

SEQ ID NO: 2412 - DNA, 16 bp, Artificial sequence
  Synthetic oligonucleotide
tcatttggcagccaca

SEQ ID NO: 2413 - DNA, 16 bp, Artificial sequence
  Synthetic oligonucleotide
tatcatttggcagcca

SEQ ID NO: 2414 - DNA, 16 bp, Artificial sequence
  Synthetic oligonucleotide
tgttatcatttggcag

SEQ ID NO: 2415 - DNA, 16 bp, Artificial sequence
  Synthetic oligonucleotide
ccttacttgggattca

SEQ ID NO: 2416 - DNA, 16 bp, Artificial sequence
  Synthetic oligonucleotide
atgataacacagcctc

SEQ ID NO: 2417 - DNA, 16 bp, Artificial sequence
  Synthetic oligonucleotide
gatgataacacagcct

SEQ ID NO: 2418 - DNA, 16 bp, Artificial sequence
  Synthetic oligonucleotide
gggatgataacacagc

SEQ ID NO: 2419 - DNA, 16 bp, Artificial sequence
  Synthetic oligonucleotide
gagatttgtgctgctt

SEQ ID NO: 2420 - DNA, 16 bp, Artificial sequence
  Synthetic oligonucleotide
gtaagtaagcactttt

SEQ ID NO: 2421 - DNA, 16 bp, Artificial sequence
  Synthetic oligonucleotide
ggattatagcaatgcc

SEQ ID NO: 2422 - DNA, 16 bp, Artificial sequence
  Synthetic oligonucleotide
tcactttacagcctcc

SEQ ID NO: 2423 - DNA, 16 bp, Artificial sequence
  Synthetic oligonucleotide
ggattctaggaggtcg

SEQ ID NO: 2424 - DNA, 16 bp, Artificial sequence
  Synthetic oligonucleotide
attaatactcttaacg

SEQ ID NO: 2425 - DNA, 16 bp, Artificial sequence
  Synthetic oligonucleotide
actaactgggctgttc

SEQ ID NO: 2426 - DNA, 16 bp, Artificial sequence
  Synthetic oligonucleotide
gaactaactgggctgt

SEQ ID NO: 2427 - DNA, 16 bp, Artificial sequence
  Synthetic oligonucleotide
ggaaatctaacactgg

SEQ ID NO: 2428 - DNA, 16 bp, Artificial sequence
  Synthetic oligonucleotide
aactctatagatctga

SEQ ID NO: 2429 - DNA, 16 bp, Artificial sequence
  Synthetic oligonucleotide
agacatggtggaacca

SEQ ID NO: 2430 - DNA, 16 bp, Artificial sequence
  Synthetic oligonucleotide
gattacaacaacagcc

SEQ ID NO: 2431 - DNA, 16 bp, Artificial sequence
  Synthetic oligonucleotide
tgaaatcgaagccatt

SEQ ID NO: 2432 - DNA, 16 bp, Artificial sequence
  Synthetic oligonucleotide
taaatgacaagggtca

SEQ ID NO: 2433 - DNA, 16 bp, Artificial sequence
  Synthetic oligonucleotide
gctattataacttgta

SEQ ID NO: 2434 - DNA, 16 bp, Artificial sequence
  Synthetic oligonucleotide
attttaaagaagacgg

SEQ ID NO: 2435 - DNA, 16 bp, Artificial sequence
  Synthetic oligonucleotide
gctattataactccta

SEQ ID NO: 2436 - DNA, 16 bp, Artificial sequence
  Synthetic oligonucleotide
cacttaatccctattc

SEQ ID NO: 2437 - DNA, 16 bp, Artificial sequence
  Synthetic oligonucleotide
atacttatcgcctttt

SEQ ID NO: 2438 - DNA, 16 bp, Artificial sequence
  Synthetic oligonucleotide
catcatacttatcgcc

SEQ ID NO: 2439 - DNA, 16 bp, Artificial sequence
  Synthetic oligonucleotide
tccaactgtgatctct

SEQ ID NO: 2440 - DNA, 16 bp, Artificial sequence
  Synthetic oligonucleotide
ccaaggaacacatcac

SEQ ID NO: 2441 - DNA, 16 bp, Artificial sequence
  Synthetic oligonucleotide
actaataagatctgtt

SEQ ID NO: 2442 - DNA, 16 bp, Artificial sequence
  Synthetic oligonucleotide
tgcaatttgtctttgc

SEQ ID NO: 2443 - DNA, 16 bp, Artificial sequence
  Synthetic oligonucleotide
caagatgcaatttgtc

SEQ ID NO: 2444 - DNA, 16 bp, Artificial sequence
  Synthetic oligonucleotide
cgagatcacaaatgct

SEQ ID NO: 2445 - DNA, 16 bp, Artificial sequence
  Synthetic oligonucleotide
agtaatgatgagttcc

SEQ ID NO: 2446 - DNA, 16 bp, Artificial sequence
  Synthetic oligonucleotide
cactgataggcactcc

SEQ ID NO: 2447 - DNA, 16 bp, Artificial sequence
  Synthetic oligonucleotide
attacttgtttgcagc

SEQ ID NO: 2448 - DNA, 16 bp, Artificial sequence
  Synthetic oligonucleotide
ccaattacttgtttgc

SEQ ID NO: 2449 - DNA, 16 bp, Artificial sequence
  Synthetic oligonucleotide
taaataactctcacgg

SEQ ID NO: 2450 - DNA, 16 bp, Artificial sequence
  Synthetic oligonucleotide
gtaaataactctcacg

SEQ ID NO: 2451 - DNA, 16 bp, Artificial sequence
  Synthetic oligonucleotide
gtgtaaataactctca

SEQ ID NO: 2452 - DNA, 16 bp, Artificial sequence
  Synthetic oligonucleotide
gttgatagtcggttgt

SEQ ID NO: 2453 - DNA, 16 bp, Artificial sequence
  Synthetic oligonucleotide
ggtcattaaagattct

SEQ ID NO: 2454 - DNA, 16 bp, Artificial sequence
  Synthetic oligonucleotide
ggtacctaacaggtct

SEQ ID NO: 2455 - DNA, 16 bp, Artificial sequence
  Synthetic oligonucleotide
gtctttccggtctttt

SEQ ID NO: 2456 - DNA, 16 bp, Artificial sequence
  Synthetic oligonucleotide
gattataaacctaatc

SEQ ID NO: 2457 - DNA, 16 bp, Artificial sequence
  Synthetic oligonucleotide
tcaataagtaactctg

SEQ ID NO: 2458 - DNA, 16 bp, Artificial sequence
  Synthetic oligonucleotide
gtcaataagtaactct

SEQ ID NO: 2459 - DNA, 16 bp, Artificial sequence
  Synthetic oligonucleotide
acctatcaagggctgt

SEQ ID NO: 2460 - DNA, 16 bp, Artificial sequence
  Synthetic oligonucleotide
gttatgaacctatcaa

SEQ ID NO: 2461 - DNA, 16 bp, Artificial sequence
  Synthetic oligonucleotide
tgttatgaacctatca

SEQ ID NO: 2462 - DNA, 16 bp, Artificial sequence
  Synthetic oligonucleotide
gtttacatgatgttct

SEQ ID NO: 2463 - DNA, 16 bp, Artificial sequence
  Synthetic oligonucleotide
gtaaattacggtttac

SEQ ID NO: 2464 - DNA, 16 bp, Artificial sequence
  Synthetic oligonucleotide
agtaaattacggttta

SEQ ID NO: 2465 - DNA, 16 bp, Artificial sequence
  Synthetic oligonucleotide
cttaattacagcttgt

SEQ ID NO: 2466 - DNA, 16 bp, Artificial sequence
  Synthetic oligonucleotide
tcattattggcttgga

SEQ ID NO: 2467 - DNA, 16 bp, Artificial sequence
  Synthetic oligonucleotide
ctcattattggcttgg

SEQ ID NO: 2468 - DNA, 16 bp, Artificial sequence
  Synthetic oligonucleotide
cctttattcagattgt

SEQ ID NO: 2469 - DNA, 16 bp, Artificial sequence
  Synthetic oligonucleotide
agtcatccagctcccg

SEQ ID NO: 2470 - DNA, 16 bp, Artificial sequence
  Synthetic oligonucleotide
ataaatgtccagcagc

SEQ ID NO: 2471 - DNA, 16 bp, Artificial sequence
  Synthetic oligonucleotide
tcataaatgtccagca

SEQ ID NO: 2472 - DNA, 16 bp, Artificial sequence
  Synthetic oligonucleotide
atcataaatgtccagc

SEQ ID NO: 2473 - DNA, 16 bp, Artificial sequence
  Synthetic oligonucleotide
gccatatgtgtggctc

SEQ ID NO: 2474 - DNA, 16 bp, Artificial sequence
  Synthetic oligonucleotide
tgtaatcttggcccag

SEQ ID NO: 2475 - DNA, 16 bp, Artificial sequence
  Synthetic oligonucleotide
tgcatatccaaagcca

SEQ ID NO: 2476 - DNA, 16 bp, Artificial sequence
  Synthetic oligonucleotide
ccacatgtgaagcagc

SEQ ID NO: 2477 - DNA, 16 bp, Artificial sequence
  Synthetic oligonucleotide
ggctattccactgcag

SEQ ID NO: 2478 - DNA, 16 bp, Artificial sequence
  Synthetic oligonucleotide
tctgtaatggtttccc

SEQ ID NO: 2479 - DNA, 16 bp, Artificial sequence
  Synthetic oligonucleotide
tgtacctaagtacaga

SEQ ID NO: 2480 - DNA, 16 bp, Artificial sequence
  Synthetic oligonucleotide
tctataggtaccagca

SEQ ID NO: 2481 - DNA, 16 bp, Artificial sequence
  Synthetic oligonucleotide
agtgaaattcactcca

SEQ ID NO: 2482 - DNA, 16 bp, Artificial sequence
  Synthetic oligonucleotide
ctctttatatagatgg

SEQ ID NO: 2483 - DNA, 16 bp, Artificial sequence
  Synthetic oligonucleotide
agagatacatcaaccc

SEQ ID NO: 2484 - DNA, 16 bp, Artificial sequence
  Synthetic oligonucleotide
aaatatagcagggacc

SEQ ID NO: 2485 - DNA, 16 bp, Artificial sequence
  Synthetic oligonucleotide
actaaatatagcaggg

SEQ ID NO: 2486 - DNA, 16 bp, Artificial sequence
  Synthetic oligonucleotide
ggcactaaatatagca

SEQ ID NO: 2487 - DNA, 16 bp, Artificial sequence
  Synthetic oligonucleotide
tagtataccaaggtta

SEQ ID NO: 2488 - DNA, 16 bp, Artificial sequence
  Synthetic oligonucleotide
gtagtataccaaggtt

SEQ ID NO: 2489 - DNA, 16 bp, Artificial sequence
  Synthetic oligonucleotide
cagtatgtatacttcc

SEQ ID NO: 2490 - DNA, 16 bp, Artificial sequence
  Synthetic oligonucleotide
tcagtatgtatacttc

SEQ ID NO: 2491 - DNA, 16 bp, Artificial sequence
  Synthetic oligonucleotide
tcctgataagattcac

SEQ ID NO: 2492 - DNA, 16 bp, Artificial sequence
  Synthetic oligonucleotide
tcagttatcactgtca

SEQ ID NO: 2493 - DNA, 16 bp, Artificial sequence
  Synthetic oligonucleotide
actagtaactttccag

SEQ ID NO: 2494 - DNA, 16 bp, Artificial sequence
  Synthetic oligonucleotide
ggattattacatgagt

SEQ ID NO: 2495 - DNA, 16 bp, Artificial sequence
  Synthetic oligonucleotide
gaggattattacatga

SEQ ID NO: 2496 - DNA, 16 bp, Artificial sequence
  Synthetic oligonucleotide
gccaactaattccaga

SEQ ID NO: 2497 - DNA, 16 bp, Artificial sequence
  Synthetic oligonucleotide
atatatgtggaggcaa

SEQ ID NO: 2498 - DNA, 16 bp, Artificial sequence
  Synthetic oligonucleotide
tatatatgtggaggca

SEQ ID NO: 2499 - DNA, 16 bp, Artificial sequence
  Synthetic oligonucleotide
aatatatatgtggagg

SEQ ID NO: 2500 - DNA, 16 bp, Artificial sequence
  Synthetic oligonucleotide
cactattggcacacca

SEQ ID NO: 2501 - DNA, 16 bp, Artificial sequence
  Synthetic oligonucleotide
acactattggcacacc

SEQ ID NO: 2502 - DNA, 16 bp, Artificial sequence
  Synthetic oligonucleotide
aacactattggcacac

SEQ ID NO: 2503 - DNA, 16 bp, Artificial sequence
  Synthetic oligonucleotide
ttcttaacaggctccc

SEQ ID NO: 2504 - DNA, 16 bp, Artificial sequence
  Synthetic oligonucleotide
taagtatgcgctgcca

SEQ ID NO: 2505 - DNA, 16 bp, Artificial sequence
  Synthetic oligonucleotide
aggatatagggtctcc

SEQ ID NO: 2506 - DNA, 16 bp, Artificial sequence
  Synthetic oligonucleotide
aaggatatagggtctc

SEQ ID NO: 2507 - DNA, 16 bp, Artificial sequence
  Synthetic oligonucleotide
gaacatcatggagcct

SEQ ID NO: 2508 - DNA, 16 bp, Artificial sequence
  Synthetic oligonucleotide
tttgatactgatctca

SEQ ID NO: 2509 - DNA, 16 bp, Artificial sequence
  Synthetic oligonucleotide
ggtattatggtatgtg

SEQ ID NO: 2510 - DNA, 16 bp, Artificial sequence
  Synthetic oligonucleotide
aggtattatggtatgt

SEQ ID NO: 2511 - DNA, 16 bp, Artificial sequence
  Synthetic oligonucleotide
tcatatgtatgggttt

SEQ ID NO: 2512 - DNA, 16 bp, Artificial sequence
  Synthetic oligonucleotide
cttcatatgtatgggt

SEQ ID NO: 2513 - DNA, 16 bp, Artificial sequence
  Synthetic oligonucleotide
atagatgtaagcaact

SEQ ID NO: 2514 - DNA, 16 bp, Artificial sequence
  Synthetic oligonucleotide
ggaaattcatagatgt

SEQ ID NO: 2515 - DNA, 16 bp, Artificial sequence
  Synthetic oligonucleotide
acttatggatgcagct

SEQ ID NO: 2516 - DNA, 16 bp, Artificial sequence
  Synthetic oligonucleotide
aacttatggatgcagc

SEQ ID NO: 2517 - DNA, 16 bp, Artificial sequence
  Synthetic oligonucleotide
agcattggtatcaggc

SEQ ID NO: 2518 - DNA, 16 bp, Artificial sequence
  Synthetic oligonucleotide
tggatatcagcattgg

SEQ ID NO: 2519 - DNA, 16 bp, Artificial sequence
  Synthetic oligonucleotide
atggatggatatcagc

SEQ ID NO: 2520 - DNA, 16 bp, Artificial sequence
  Synthetic oligonucleotide
ttcaatcatggatgga

SEQ ID NO: 2521 - DNA, 16 bp, Artificial sequence
  Synthetic oligonucleotide
ggaatacttgcagcta

SEQ ID NO: 2522 - DNA, 16 bp, Artificial sequence
  Synthetic oligonucleotide
aggaatacttgcagct

SEQ ID NO: 2523 - DNA, 16 bp, Artificial sequence
  Synthetic oligonucleotide
caacatggcactccct

SEQ ID NO: 2524 - DNA, 16 bp, Artificial sequence
  Synthetic oligonucleotide
tctgatgcaacatggc

SEQ ID NO: 2525 - DNA, 16 bp, Artificial sequence
  Synthetic oligonucleotide
atcattgggtgaagac

SEQ ID NO: 2526 - DNA, 16 bp, Artificial sequence
  Synthetic oligonucleotide
ggtctattggcacaca

SEQ ID NO: 2527 - DNA, 16 bp, Artificial sequence
  Synthetic oligonucleotide
agattaagtcatccgg

SEQ ID NO: 2528 - DNA, 16 bp, Artificial sequence
  Synthetic oligonucleotide
gagattaagtcatccg

SEQ ID NO: 2529 - DNA, 16 bp, Artificial sequence
  Synthetic oligonucleotide
agagattaagtcatcc

SEQ ID NO: 2530 - DNA, 16 bp, Artificial sequence
  Synthetic oligonucleotide
gcaaatgctagctgca

SEQ ID NO: 2531 - DNA, 16 bp, Artificial sequence
  Synthetic oligonucleotide
cgctctaatgtcctga

SEQ ID NO: 2532 - DNA, 16 bp, Artificial sequence
  Synthetic oligonucleotide
tggatatccagaccca

SEQ ID NO: 2533 - DNA, 16 bp, Artificial sequence
  Synthetic oligonucleotide
gcagatcctgccttgg

SEQ ID NO: 2534 - DNA, 16 bp, Artificial sequence
  Synthetic oligonucleotide
tgaactagaggcaggc

SEQ ID NO: 2535 - DNA, 16 bp, Artificial sequence
  Synthetic oligonucleotide
gtgaactagaggcagg

SEQ ID NO: 2536 - DNA, 16 bp, Artificial sequence
  Synthetic oligonucleotide
tgtaactttcagcagt

SEQ ID NO: 2537 - DNA, 16 bp, Artificial sequence
  Synthetic oligonucleotide
tgtgattgcaggccag

SEQ ID NO: 2538 - DNA, 16 bp, Artificial sequence
  Synthetic oligonucleotide
ttttatagtctccaac

SEQ ID NO: 2539 - DNA, 16 bp, Artificial sequence
  Synthetic oligonucleotide
tgtatggacagcaggc

SEQ ID NO: 2540 - DNA, 16 bp, Artificial sequence
  Synthetic oligonucleotide
gtgtatggacagcagg

SEQ ID NO: 2541 - DNA, 16 bp, Artificial sequence
  Synthetic oligonucleotide
atcaatcttgggagct

SEQ ID NO: 2542 - DNA, 16 bp, Artificial sequence
  Synthetic oligonucleotide
ctaaatcaatcttggg

SEQ ID NO: 2543 - DNA, 16 bp, Artificial sequence
  Synthetic oligonucleotide
atattaatgcagtggt

SEQ ID NO: 2544 - DNA, 16 bp, Artificial sequence
  Synthetic oligonucleotide
catattaatgcagtgg

SEQ ID NO: 2545 - DNA, 16 bp, Artificial sequence
  Synthetic oligonucleotide
acatattaatgcagtg

SEQ ID NO: 2546 - DNA, 16 bp, Artificial sequence
  Synthetic oligonucleotide
agaatatcaacacctt

SEQ ID NO: 2547 - DNA, 16 bp, Artificial sequence
  Synthetic oligonucleotide
tagaatatcaacacct

SEQ ID NO: 2548 - DNA, 16 bp, Artificial sequence
  Synthetic oligonucleotide
ttatctaacagtccca

SEQ ID NO: 2549 - DNA, 16 bp, Artificial sequence
  Synthetic oligonucleotide
catttatctaacagtc

SEQ ID NO: 2550 - DNA, 16 bp, Artificial sequence
  Synthetic oligonucleotide
tagtgatatgctgcct

SEQ ID NO: 2551 - DNA, 16 bp, Artificial sequence
  Synthetic oligonucleotide
cacaatcctggctatc

SEQ ID NO: 2552 - DNA, 16 bp, Artificial sequence
  Synthetic oligonucleotide
ccagacattgctgtcg

SEQ ID NO: 2553 - DNA, 16 bp, Artificial sequence
  Synthetic oligonucleotide
acatttgacggtttga

SEQ ID NO: 2554 - DNA, 16 bp, Artificial sequence
  Synthetic oligonucleotide
gggaatgatgccacct

SEQ ID NO: 2555 - DNA, 16 bp, Artificial sequence
  Synthetic oligonucleotide
ccaatctgttatgtgg

SEQ ID NO: 2556 - DNA, 16 bp, Artificial sequence
  Synthetic oligonucleotide
tggaatccagtatttc

SEQ ID NO: 2557 - DNA, 16 bp, Artificial sequence
  Synthetic oligonucleotide
aggaatcctgcagctc

SEQ ID NO: 2558 - DNA, 16 bp, Artificial sequence
  Synthetic oligonucleotide
tcctattagagtggca

SEQ ID NO: 2559 - DNA, 16 bp, Artificial sequence
  Synthetic oligonucleotide
agcattaacagagcag

SEQ ID NO: 2560 - DNA, 16 bp, Artificial sequence
  Synthetic oligonucleotide
ggctttactccagcca

SEQ ID NO: 2561 - DNA, 16 bp, Artificial sequence
  Synthetic oligonucleotide
aacaatagccattggt

SEQ ID NO: 2562 - DNA, 16 bp, Artificial sequence
  Synthetic oligonucleotide
tgtttatttaccgttt

SEQ ID NO: 2563 - DNA, 16 bp, Artificial sequence
  Synthetic oligonucleotide
agtactattgcatcat

SEQ ID NO: 2564 - DNA, 16 bp, Artificial sequence
  Synthetic oligonucleotide
tcacatacagacccca

SEQ ID NO: 2565 - DNA, 16 bp, Artificial sequence
  Synthetic oligonucleotide
ctaaatgtcacttagc

SEQ ID NO: 2566 - DNA, 16 bp, Artificial sequence
  Synthetic oligonucleotide
ggaactaacacatgct

SEQ ID NO: 2567 - DNA, 16 bp, Artificial sequence
  Synthetic oligonucleotide
gaaatctacctactcc

SEQ ID NO: 2568 - DNA, 16 bp, Artificial sequence
  Synthetic oligonucleotide
tgaaatctacctactc

SEQ ID NO: 2569 - DNA, 16 bp, Artificial sequence
  Synthetic oligonucleotide
ggcaccaacattcacc

SEQ ID NO: 2570 - DNA, 16 bp, Artificial sequence
  Synthetic oligonucleotide
tccgattttgcttcta

SEQ ID NO: 2571 - DNA, 16 bp, Artificial sequence
  Synthetic oligonucleotide
acttatccgattttgc

SEQ ID NO: 2572 - DNA, 16 bp, Artificial sequence
  Synthetic oligonucleotide
tgttattccgaacagt

SEQ ID NO: 2573 - DNA, 16 bp, Artificial sequence
  Synthetic oligonucleotide
tctcatggcgactggc

SEQ ID NO: 2574 - DNA, 16 bp, Artificial sequence
  Synthetic oligonucleotide
ggaataaaggctctcg

SEQ ID NO: 2575 - DNA, 16 bp, Artificial sequence
  Synthetic oligonucleotide
ttagattgtatgaccc

SEQ ID NO: 2576 - DNA, 16 bp, Artificial sequence
  Synthetic oligonucleotide
ggctttgttagatgcc

SEQ ID NO: 2577 - DNA, 16 bp, Artificial sequence
  Synthetic oligonucleotide
attcatagtaccccac

SEQ ID NO: 2578 - DNA, 16 bp, Artificial sequence
  Synthetic oligonucleotide
gtatttgtagtgtgga

SEQ ID NO: 2579 - DNA, 16 bp, Artificial sequence
  Synthetic oligonucleotide
ggtatttgtagtgtgg

SEQ ID NO: 2580 - DNA, 16 bp, Artificial sequence
  Synthetic oligonucleotide
gacaatggtgatgccc

SEQ ID NO: 2581 - DNA, 16 bp, Artificial sequence
  Synthetic oligonucleotide
atcttaggcagaccct

SEQ ID NO: 2582 - DNA, 16 bp, Artificial sequence
  Synthetic oligonucleotide
acacatcttaggcaga

SEQ ID NO: 2583 - DNA, 16 bp, Artificial sequence
  Synthetic oligonucleotide
attaaaatgggtctgc

SEQ ID NO: 2584 - DNA, 16 bp, Artificial sequence
  Synthetic oligonucleotide
catttaaccatgacag

SEQ ID NO: 2585 - DNA, 16 bp, Artificial sequence
  Synthetic oligonucleotide
ccatttaaccatgaca

SEQ ID NO: 2586 - DNA, 16 bp, Artificial sequence
  Synthetic oligonucleotide
accttaagttttttgg

SEQ ID NO: 2587 - DNA, 16 bp, Artificial sequence
  Synthetic oligonucleotide
gctaatagctattcaa

SEQ ID NO: 2588 - DNA, 16 bp, Artificial sequence
  Synthetic oligonucleotide
cgcattactgagttca

SEQ ID NO: 2589 - DNA, 16 bp, Artificial sequence
  Synthetic oligonucleotide
gtgactaagacaacca

SEQ ID NO: 2590 - DNA, 16 bp, Artificial sequence
  Synthetic oligonucleotide
agacatgtaactccct

SEQ ID NO: 2591 - DNA, 16 bp, Artificial sequence
  Synthetic oligonucleotide
ctagacatgtaactcc

SEQ ID NO: 2592 - DNA, 16 bp, Artificial sequence
  Synthetic oligonucleotide
gcctatccatgctgct

SEQ ID NO: 2593 - DNA, 16 bp, Artificial sequence
  Synthetic oligonucleotide
cagaattgttacaacc

SEQ ID NO: 2594 - DNA, 16 bp, Artificial sequence
  Synthetic oligonucleotide
ccattaaaatttgccc

SEQ ID NO: 2595 - DNA, 16 bp, Artificial sequence
  Synthetic oligonucleotide
tccattaaaatttgcc

SEQ ID NO: 2596 - DNA, 16 bp, Artificial sequence
  Synthetic oligonucleotide
ttaactatatctaact

SEQ ID NO: 2597 - DNA, 16 bp, Artificial sequence
  Synthetic oligonucleotide
cgattaactatatcta

SEQ ID NO: 2598 - DNA, 16 bp, Artificial sequence
  Synthetic oligonucleotide
atttatgcgattggcc

SEQ ID NO: 2599 - DNA, 16 bp, Artificial sequence
  Synthetic oligonucleotide
gatttatgcgattggc

SEQ ID NO: 2600 - DNA, 16 bp, Artificial sequence
  Synthetic oligonucleotide
agatttatgcgattgg

SEQ ID NO: 2601 - DNA, 16 bp, Artificial sequence
  Synthetic oligonucleotide
tgtttaagatttatgc

SEQ ID NO: 2602 - DNA, 16 bp, Artificial sequence
  Synthetic oligonucleotide
aaagtaattcactgcg

SEQ ID NO: 2603 - DNA, 16 bp, Artificial sequence
  Synthetic oligonucleotide
atggactacagtctgt

SEQ ID NO: 2604 - DNA, 16 bp, Artificial sequence
  Synthetic oligonucleotide
tgcaatcacagacatc

SEQ ID NO: 2605 - DNA, 16 bp, Artificial sequence
  Synthetic oligonucleotide
gtattaacctcatgaa

SEQ ID NO: 2606 - DNA, 16 bp, Artificial sequence
  Synthetic oligonucleotide
ggtattaacctcatga

SEQ ID NO: 2607 - DNA, 16 bp, Artificial sequence
  Synthetic oligonucleotide
gtctttccgtcacagt

SEQ ID NO: 2608 - DNA, 16 bp, Artificial sequence
  Synthetic oligonucleotide
ggataattggagaggg

SEQ ID NO: 2609 - DNA, 16 bp, Artificial sequence
  Synthetic oligonucleotide
gggataattggagagg

SEQ ID NO: 2610 - DNA, 16 bp, Artificial sequence
  Synthetic oligonucleotide
gggattatgatgagga

SEQ ID NO: 2611 - DNA, 16 bp, Artificial sequence
  Synthetic oligonucleotide
gatgatgggttctagc

SEQ ID NO: 2612 - DNA, 16 bp, Artificial sequence
  Synthetic oligonucleotide
gggagatgtgctcttt

SEQ ID NO: 2613 - DNA, 16 bp, Artificial sequence
  Synthetic oligonucleotide
gtattacccagtggct

SEQ ID NO: 2614 - DNA, 16 bp, Artificial sequence
  Synthetic oligonucleotide
tgtattacccagtggc

SEQ ID NO: 2615 - DNA, 16 bp, Artificial sequence
  Synthetic oligonucleotide
gggaatgtattaccca

SEQ ID NO: 2616 - DNA, 16 bp, Artificial sequence
  Synthetic oligonucleotide
tacaatcattcccagc

SEQ ID NO: 2617 - DNA, 16 bp, Artificial sequence
  Synthetic oligonucleotide
agcactacaatcattc

SEQ ID NO: 2618 - DNA, 16 bp, Artificial sequence
  Synthetic oligonucleotide
tactgtacagctgtgc

SEQ ID NO: 2619 - DNA, 16 bp, Artificial sequence
  Synthetic oligonucleotide
ggcaattggtactgta

SEQ ID NO: 2620 - DNA, 16 bp, Artificial sequence
  Synthetic oligonucleotide
gaaaatttgtacagga

SEQ ID NO: 2621 - DNA, 16 bp, Artificial sequence
  Synthetic oligonucleotide
tacattaaaggctcga

SEQ ID NO: 2622 - DNA, 16 bp, Artificial sequence
  Synthetic oligonucleotide
gtacatatcctggccg

SEQ ID NO: 2623 - DNA, 16 bp, Artificial sequence
  Synthetic oligonucleotide
tactattcgacagagc

SEQ ID NO: 2624 - DNA, 16 bp, Artificial sequence
  Synthetic oligonucleotide
attactattcgacaga

SEQ ID NO: 2625 - DNA, 16 bp, Artificial sequence
  Synthetic oligonucleotide
taaattactattcgac

SEQ ID NO: 2626 - DNA, 16 bp, Artificial sequence
  Synthetic oligonucleotide
gtaaattactattcga

SEQ ID NO: 2627 - DNA, 16 bp, Artificial sequence
  Synthetic oligonucleotide
tgtaaattactattcg

SEQ ID NO: 2628 - DNA, 16 bp, Artificial sequence
  Synthetic oligonucleotide
gagatcaacacatttc

SEQ ID NO: 2629 - DNA, 16 bp, Artificial sequence
  Synthetic oligonucleotide
agaaattactcttgcg

SEQ ID NO: 2630 - DNA, 16 bp, Artificial sequence
  Synthetic oligonucleotide
tccaatgacagcccag

SEQ ID NO: 2631 - DNA, 16 bp, Artificial sequence
  Synthetic oligonucleotide
gtgaattcaatgtcca

SEQ ID NO: 2632 - DNA, 16 bp, Artificial sequence
  Synthetic oligonucleotide
acacatgtggaacacg

SEQ ID NO: 2633 - DNA, 16 bp, Artificial sequence
  Synthetic oligonucleotide
tatctataacacatga

SEQ ID NO: 2634 - DNA, 16 bp, Artificial sequence
  Synthetic oligonucleotide
ggttatctataacaca

SEQ ID NO: 2635 - DNA, 16 bp, Artificial sequence
  Synthetic oligonucleotide
gtctttattgcatggg

SEQ ID NO: 2636 - DNA, 16 bp, Artificial sequence
  Synthetic oligonucleotide
gctataaaaccagcca

SEQ ID NO: 2637 - DNA, 16 bp, Artificial sequence
  Synthetic oligonucleotide
agcattggattgagca

SEQ ID NO: 2638 - DNA, 16 bp, Artificial sequence
  Synthetic oligonucleotide
agcaatggtggccggg

SEQ ID NO: 2639 - DNA, 16 bp, Artificial sequence
  Synthetic oligonucleotide
ctatattcaacaggct

SEQ ID NO: 2640 - DNA, 16 bp, Artificial sequence
  Synthetic oligonucleotide
actatattcaacaggc

SEQ ID NO: 2641 - DNA, 16 bp, Artificial sequence
  Synthetic oligonucleotide
ggccatactatattca

SEQ ID NO: 2642 - DNA, 16 bp, Artificial sequence
  Synthetic oligonucleotide
gggatatacgcccacc

SEQ ID NO: 2643 - DNA, 16 bp, Artificial sequence
  Synthetic oligonucleotide
tatttaaaagggccgc

SEQ ID NO: 2644 - DNA, 16 bp, Artificial sequence
  Synthetic oligonucleotide
gtatttaaaagggccg

SEQ ID NO: 2645 - DNA, 16 bp, Artificial sequence
  Synthetic oligonucleotide
cgaaatagcagagctc

SEQ ID NO: 2646 - DNA, 16 bp, Artificial sequence
  Synthetic oligonucleotide
tctatagtgactctca

SEQ ID NO: 2647 - DNA, 16 bp, Artificial sequence
  Synthetic oligonucleotide
ttctatagtgactctc

SEQ ID NO: 2648 - DNA, 16 bp, Artificial sequence
  Synthetic oligonucleotide
gttcatccgggtcagg

SEQ ID NO: 2649 - DNA, 16 bp, Artificial sequence
  Synthetic oligonucleotide
gcaactatgcatccac

SEQ ID NO: 2650 - DNA, 16 bp, Artificial sequence
  Synthetic oligonucleotide
gaacatggcagccagt

SEQ ID NO: 2651 - DNA, 16 bp, Artificial sequence
  Synthetic oligonucleotide
tgcttaatgccttgcc

SEQ ID NO: 2652 - DNA, 16 bp, Artificial sequence
  Synthetic oligonucleotide
cgcaatgtgttcattt

SEQ ID NO: 2653 - DNA, 16 bp, Artificial sequence
  Synthetic oligonucleotide
actttaacaagtcccg

SEQ ID NO: 2654 - DNA, 16 bp, Artificial sequence
  Synthetic oligonucleotide
cactttaacaagtccc

SEQ ID NO: 2655 - DNA, 16 bp, Artificial sequence
  Synthetic oligonucleotide
acagatgaagctacca

SEQ ID NO: 2656 - DNA, 16 bp, Artificial sequence
  Synthetic oligonucleotide
ggttatggtcttaggt

SEQ ID NO: 2657 - DNA, 16 bp, Artificial sequence
  Synthetic oligonucleotide
tcgatttgattctgag

SEQ ID NO: 2658 - DNA, 16 bp, Artificial sequence
  Synthetic oligonucleotide
gacaaattgccactgg

SEQ ID NO: 2659 - DNA, 16 bp, Artificial sequence
  Synthetic oligonucleotide
gcaaatatctcccagt

SEQ ID NO: 2660 - DNA, 16 bp, Artificial sequence
  Synthetic oligonucleotide
acaatgacgaggctgg

SEQ ID NO: 2661 - DNA, 16 bp, Artificial sequence
  Synthetic oligonucleotide
tcaaatcccatcagga

SEQ ID NO: 2662 - DNA, 16 bp, Artificial sequence
  Synthetic oligonucleotide
tgtacttgcgggtttt

SEQ ID NO: 2663 - DNA, 16 bp, Artificial sequence
  Synthetic oligonucleotide
agcaatcacgctgcca

SEQ ID NO: 2664 - DNA, 16 bp, Artificial sequence
  Synthetic oligonucleotide
agtcatccagcaatca

SEQ ID NO: 2665 - DNA, 16 bp, Artificial sequence
  Synthetic oligonucleotide
attaatctgggcagtc

SEQ ID NO: 2666 - DNA, 16 bp, Artificial sequence
  Synthetic oligonucleotide
gattaatctgggcagt

SEQ ID NO: 2667 - DNA, 16 bp, Artificial sequence
  Synthetic oligonucleotide
taaaggattaatctgg

SEQ ID NO: 2668 - DNA, 16 bp, Artificial sequence
  Synthetic oligonucleotide
attttgatagctccac

SEQ ID NO: 2669 - DNA, 16 bp, Artificial sequence
  Synthetic oligonucleotide
gcattttgatagctcc

SEQ ID NO: 2670 - DNA, 16 bp, Artificial sequence
  Synthetic oligonucleotide
ggtttaaaagcttcca

SEQ ID NO: 2671 - DNA, 16 bp, Artificial sequence
  Synthetic oligonucleotide
gtaaatgctgaatgcc

SEQ ID NO: 2672 - DNA, 16 bp, Artificial sequence
  Synthetic oligonucleotide
ggatatggacagcagg

SEQ ID NO: 2673 - DNA, 16 bp, Artificial sequence
  Synthetic oligonucleotide
aggatatggacagcag

SEQ ID NO: 2674 - DNA, 16 bp, Artificial sequence
  Synthetic oligonucleotide
tcacatgccagacttt

SEQ ID NO: 2675 - DNA, 16 bp, Artificial sequence
  Synthetic oligonucleotide
cacactcacgcatgtt

SEQ ID NO: 2676 - DNA, 16 bp, Artificial sequence
  Synthetic oligonucleotide
tttaccttgaatgtcc

SEQ ID NO: 2677 - DNA, 16 bp, Artificial sequence
  Synthetic oligonucleotide
gcaagctactctctca

SEQ ID NO: 2678 - DNA, 16 bp, Artificial sequence
  Synthetic oligonucleotide
tcaatacctgcacagg

SEQ ID NO: 2679 - DNA, 16 bp, Artificial sequence
  Synthetic oligonucleotide
gtcaatacctgcacag

SEQ ID NO: 2680 - DNA, 16 bp, Artificial sequence
  Synthetic oligonucleotide
tgtatgaggactcaga

SEQ ID NO: 2681 - DNA, 16 bp, Artificial sequence
  Synthetic oligonucleotide
atcataacaggctgta

SEQ ID NO: 2682 - DNA, 16 bp, Artificial sequence
  Synthetic oligonucleotide
catcataacaggctgt

SEQ ID NO: 2683 - DNA, 16 bp, Artificial sequence
  Synthetic oligonucleotide
taaaatgcgcatcata

SEQ ID NO: 2684 - DNA, 16 bp, Artificial sequence
  Synthetic oligonucleotide
gtaatgagctcagtct

SEQ ID NO: 2685 - DNA, 16 bp, Artificial sequence
  Synthetic oligonucleotide
gaaactacggcactct

SEQ ID NO: 2686 - DNA, 16 bp, Artificial sequence
  Synthetic oligonucleotide
ggtaataagtcacact

SEQ ID NO: 2687 - DNA, 16 bp, Artificial sequence
  Synthetic oligonucleotide
gattaatatcggctga

SEQ ID NO: 2688 - DNA, 16 bp, Artificial sequence
  Synthetic oligonucleotide
tggattaatatcggct

SEQ ID NO: 2689 - DNA, 16 bp, Artificial sequence
  Synthetic oligonucleotide
atggattaatatcggc

SEQ ID NO: 2690 - DNA, 16 bp, Artificial sequence
  Synthetic oligonucleotide
gttcatcacggaaggt

SEQ ID NO: 2691 - DNA, 16 bp, Artificial sequence
  Synthetic oligonucleotide
ccgaatcacagattga

SEQ ID NO: 2692 - DNA, 16 bp, Artificial sequence
  Synthetic oligonucleotide
gtaattgacaagcagt

SEQ ID NO: 2693 - DNA, 16 bp, Artificial sequence
  Synthetic oligonucleotide
taagtaattgacaagc

SEQ ID NO: 2694 - DNA, 16 bp, Artificial sequence
  Synthetic oligonucleotide
gtatataagacccggg

SEQ ID NO: 2695 - DNA, 16 bp, Artificial sequence
  Synthetic oligonucleotide
tgtatataagacccgg

SEQ ID NO: 2696 - DNA, 16 bp, Artificial sequence
  Synthetic oligonucleotide
gtgtatataagacccg

SEQ ID NO: 2697 - DNA, 16 bp, Artificial sequence
  Synthetic oligonucleotide
agtgtatataagaccc

SEQ ID NO: 2698 - DNA, 16 bp, Artificial sequence
  Synthetic oligonucleotide
gactattcaagagggc

SEQ ID NO: 2699 - DNA, 16 bp, Artificial sequence
  Synthetic oligonucleotide
tctcatggcactcact

SEQ ID NO: 2700 - DNA, 16 bp, Artificial sequence
  Synthetic oligonucleotide
attcatggtccaccag

SEQ ID NO: 2701 - DNA, 16 bp, Artificial sequence
  Synthetic oligonucleotide
ggtgatgctgcagagc

SEQ ID NO: 2702 - DNA, 16 bp, Artificial sequence
  Synthetic oligonucleotide
caggatacatcaccca

SEQ ID NO: 2703 - DNA, 16 bp, Artificial sequence
  Synthetic oligonucleotide
tattatgaatccccct

SEQ ID NO: 2704 - DNA, 16 bp, Artificial sequence
  Synthetic oligonucleotide
atattatgaatccccc

SEQ ID NO: 2705 - DNA, 16 bp, Artificial sequence
  Synthetic oligonucleotide
acatattatgaatccc

SEQ ID NO: 2706 - DNA, 16 bp, Artificial sequence
  Synthetic oligonucleotide
agtaatgacccaggct

SEQ ID NO: 2707 - DNA, 16 bp, Artificial sequence
  Synthetic oligonucleotide
agtgatgggtccccac

SEQ ID NO: 2708 - DNA, 16 bp, Artificial sequence
  Synthetic oligonucleotide
gtgaatatcaactgtt

SEQ ID NO: 2709 - DNA, 16 bp, Artificial sequence
  Synthetic oligonucleotide
gcagatctggctgcct

SEQ ID NO: 2710 - DNA, 16 bp, Artificial sequence
  Synthetic oligonucleotide
aggatatttggctggg

SEQ ID NO: 2711 - DNA, 16 bp, Artificial sequence
  Synthetic oligonucleotide
acttatcgcaaggaac

SEQ ID NO: 2712 - DNA, 16 bp, Artificial sequence
  Synthetic oligonucleotide
gcgatatacctttctg

SEQ ID NO: 2713 - DNA, 16 bp, Artificial sequence
  Synthetic oligonucleotide
tgcgatatacctttct

SEQ ID NO: 2714 - DNA, 16 bp, Artificial sequence
  Synthetic oligonucleotide
tgaatgacaggtgtgt

SEQ ID NO: 2715 - DNA, 16 bp, Artificial sequence
  Synthetic oligonucleotide
tacaatcacaattgct

SEQ ID NO: 2716 - DNA, 16 bp, Artificial sequence
  Synthetic oligonucleotide
gccaataccaaagaac

SEQ ID NO: 2717 - DNA, 16 bp, Artificial sequence
  Synthetic oligonucleotide
tctaaatcaggacagt

SEQ ID NO: 2718 - DNA, 16 bp, Artificial sequence
  Synthetic oligonucleotide
gcaacatgggcactgc

SEQ ID NO: 2719 - DNA, 16 bp, Artificial sequence
  Synthetic oligonucleotide
taagatcgcatctggg

SEQ ID NO: 2720 - DNA, 16 bp, Artificial sequence
  Synthetic oligonucleotide
agctatctgggttagg

SEQ ID NO: 2721 - DNA, 16 bp, Artificial sequence
  Synthetic oligonucleotide
ggaaatagacgatctc

SEQ ID NO: 2722 - DNA, 16 bp, Artificial sequence
  Synthetic oligonucleotide
ccaatttgggcatcaa

SEQ ID NO: 2723 - DNA, 16 bp, Artificial sequence
  Synthetic oligonucleotide
gccaatttgggcatca

SEQ ID NO: 2724 - DNA, 16 bp, Artificial sequence
  Synthetic oligonucleotide
gttatatgtgtggcat

SEQ ID NO: 2725 - DNA, 16 bp, Artificial sequence
  Synthetic oligonucleotide
tgttatatgtgtggca

SEQ ID NO: 2726 - DNA, 16 bp, Artificial sequence
  Synthetic oligonucleotide
gtgttatatgtgtggc

SEQ ID NO: 2727 - DNA, 16 bp, Artificial sequence
  Synthetic oligonucleotide
gctaaaattccactct

SEQ ID NO: 2728 - DNA, 16 bp, Artificial sequence
  Synthetic oligonucleotide
cgtaaacatgattcct

SEQ ID NO: 2729 - DNA, 16 bp, Artificial sequence
  Synthetic oligonucleotide
gttattaaggacaacc

SEQ ID NO: 2730 - DNA, 16 bp, Artificial sequence
  Synthetic oligonucleotide
cgttattgtcatttgt

SEQ ID NO: 2731 - DNA, 16 bp, Artificial sequence
  Synthetic oligonucleotide
tcgaatgaagatggtc

SEQ ID NO: 2732 - DNA, 16 bp, Artificial sequence
  Synthetic oligonucleotide
aatgataaggacccca

SEQ ID NO: 2733 - DNA, 16 bp, Artificial sequence
  Synthetic oligonucleotide
gtaatgataaggaccc

SEQ ID NO: 2734 - DNA, 16 bp, Artificial sequence
  Synthetic oligonucleotide
agtaatgataaggacc

SEQ ID NO: 2735 - DNA, 16 bp, Artificial sequence
  Synthetic oligonucleotide
gttaattgtgcacttg

SEQ ID NO: 2736 - DNA, 16 bp, Artificial sequence
  Synthetic oligonucleotide
tgttaattgtgcactt

SEQ ID NO: 2737 - DNA, 16 bp, Artificial sequence
  Synthetic oligonucleotide
gtgttaattgtgcact

SEQ ID NO: 2738 - DNA, 16 bp, Artificial sequence
  Synthetic oligonucleotide
agttataaaccctggg

SEQ ID NO: 2739 - DNA, 16 bp, Artificial sequence
  Synthetic oligonucleotide
acaataattggccaaa

SEQ ID NO: 2740 - DNA, 16 bp, Artificial sequence
  Synthetic oligonucleotide
gatctaattaccagct

SEQ ID NO: 2741 - DNA, 16 bp, Artificial sequence
  Synthetic oligonucleotide
tacttaggttactcct

SEQ ID NO: 2742 - DNA, 16 bp, Artificial sequence
  Synthetic oligonucleotide
gacaatgggtcaacgc

SEQ ID NO: 2743 - DNA, 16 bp, Artificial sequence
  Synthetic oligonucleotide
tgctctaaatgactgc

SEQ ID NO: 2744 - DNA, 16 bp, Artificial sequence
  Synthetic oligonucleotide
ccacatctatctcaga

SEQ ID NO: 2745 - DNA, 16 bp, Artificial sequence
  Synthetic oligonucleotide
aatatctcagcagtgc

SEQ ID NO: 2746 - DNA, 16 bp, Artificial sequence
  Synthetic oligonucleotide
caatatctcagcagtg

SEQ ID NO: 2747 - DNA, 16 bp, Artificial sequence
  Synthetic oligonucleotide
ggcctaacagtgtcca

SEQ ID NO: 2748 - DNA, 16 bp, Artificial sequence
  Synthetic oligonucleotide
agtcattagtacgcca

SEQ ID NO: 2749 - DNA, 16 bp, Artificial sequence
  Synthetic oligonucleotide
gtcttgtgggatgtga

SEQ ID NO: 2750 - DNA, 16 bp, Artificial sequence
  Synthetic oligonucleotide
tcaatacacactgttg

SEQ ID NO: 2751 - DNA, 16 bp, Artificial sequence
  Synthetic oligonucleotide
ggataattcaatacac

SEQ ID NO: 2752 - DNA, 16 bp, Artificial sequence
  Synthetic oligonucleotide
ataacatgttactcag

SEQ ID NO: 2753 - DNA, 16 bp, Artificial sequence
  Synthetic oligonucleotide
cataacatgttactca

SEQ ID NO: 2754 - DNA, 16 bp, Artificial sequence
  Synthetic oligonucleotide
gtcataacatgttact

SEQ ID NO: 2755 - DNA, 16 bp, Artificial sequence
  Synthetic oligonucleotide
tgtcataacatgttac

SEQ ID NO: 2756 - DNA, 16 bp, Artificial sequence
  Synthetic oligonucleotide
ggcactcacagctgtc

SEQ ID NO: 2757 - DNA, 16 bp, Artificial sequence
  Synthetic oligonucleotide
agctgttgtgcagtgc

SEQ ID NO: 2758 - DNA, 16 bp, Artificial sequence
  Synthetic oligonucleotide
gctaaatgtggactga

SEQ ID NO: 2759 - DNA, 16 bp, Artificial sequence
  Synthetic oligonucleotide
ggcaatgcatacagtc

SEQ ID NO: 2760 - DNA, 16 bp, Artificial sequence
  Synthetic oligonucleotide
gttattaaccccctgt

SEQ ID NO: 2761 - DNA, 16 bp, Artificial sequence
  Synthetic oligonucleotide
tcaattacttacaaga

SEQ ID NO: 2762 - DNA, 16 bp, Artificial sequence
  Synthetic oligonucleotide
tgtttatgcaccatgt

SEQ ID NO: 2763 - DNA, 16 bp, Artificial sequence
  Synthetic oligonucleotide
gaattatgccttctac

SEQ ID NO: 2764 - DNA, 16 bp, Artificial sequence
  Synthetic oligonucleotide
gtctatgtgggctgcc

SEQ ID NO: 2765 - DNA, 16 bp, Artificial sequence
  Synthetic oligonucleotide
atctatggcatggagc

SEQ ID NO: 2766 - DNA, 16 bp, Artificial sequence
  Synthetic oligonucleotide
acatctatggcatgga

SEQ ID NO: 2767 - DNA, 16 bp, Artificial sequence
  Synthetic oligonucleotide
acagataaatcaagcc

SEQ ID NO: 2768 - DNA, 16 bp, Artificial sequence
  Synthetic oligonucleotide
cactatgcggccacca

SEQ ID NO: 2769 - DNA, 16 bp, Artificial sequence
  Synthetic oligonucleotide
gtacatactgcagcag

SEQ ID NO: 2770 - DNA, 16 bp, Artificial sequence
  Synthetic oligonucleotide
ggtacatactgcagca

SEQ ID NO: 2771 - DNA, 16 bp, Artificial sequence
  Synthetic oligonucleotide
gcgaatgccatgctta

SEQ ID NO: 2772 - DNA, 16 bp, Artificial sequence
  Synthetic oligonucleotide
gacatttaacacacta

SEQ ID NO: 2773 - DNA, 16 bp, Artificial sequence
  Synthetic oligonucleotide
ggcttaatcccacacg

SEQ ID NO: 2774 - DNA, 16 bp, Artificial sequence
  Synthetic oligonucleotide
gaatttgggattgtgg

SEQ ID NO: 2775 - DNA, 16 bp, Artificial sequence
  Synthetic oligonucleotide
tcatgcatggcactgt

SEQ ID NO: 2776 - DNA, 16 bp, Artificial sequence
  Synthetic oligonucleotide
agcataaaagcactct

SEQ ID NO: 2777 - DNA, 16 bp, Artificial sequence
  Synthetic oligonucleotide
gctatgaatttcctcc

SEQ ID NO: 2778 - DNA, 16 bp, Artificial sequence
  Synthetic oligonucleotide
ggctatgaatttcctc

SEQ ID NO: 2779 - DNA, 16 bp, Artificial sequence
  Synthetic oligonucleotide
tgctatgaccctcact

SEQ ID NO: 2780 - DNA, 16 bp, Artificial sequence
  Synthetic oligonucleotide
acagataacagtggcg

SEQ ID NO: 2781 - DNA, 16 bp, Artificial sequence
  Synthetic oligonucleotide
gtaattcccgttctct

SEQ ID NO: 2782 - DNA, 16 bp, Artificial sequence
  Synthetic oligonucleotide
tctattaccgtaattc

SEQ ID NO: 2783 - DNA, 16 bp, Artificial sequence
  Synthetic oligonucleotide
tacatgaacagtctgt

SEQ ID NO: 2784 - DNA, 16 bp, Artificial sequence
  Synthetic oligonucleotide
aacttacaagcatcgg

SEQ ID NO: 2785 - DNA, 16 bp, Artificial sequence
  Synthetic oligonucleotide
tgaacttacaagcatc

SEQ ID NO: 2786 - DNA, 16 bp, Artificial sequence
  Synthetic oligonucleotide
atcaattttaaacacg

SEQ ID NO: 2787 - DNA, 16 bp, Artificial sequence
  Synthetic oligonucleotide
acaaatacatgaggtc

SEQ ID NO: 2788 - DNA, 16 bp, Artificial sequence
  Synthetic oligonucleotide
gtattattcccagcta

SEQ ID NO: 2789 - DNA, 16 bp, Artificial sequence
  Synthetic oligonucleotide
tgtattattcccagct

SEQ ID NO: 2790 - DNA, 16 bp, Artificial sequence
  Synthetic oligonucleotide
gagaatatcacagggt

SEQ ID NO: 2791 - DNA, 16 bp, Artificial sequence
  Synthetic oligonucleotide
tgtaatcagtcaagag

SEQ ID NO: 2792 - DNA, 16 bp, Artificial sequence
  Synthetic oligonucleotide
gacaattgtgaccggc

SEQ ID NO: 2793 - DNA, 16 bp, Artificial sequence
  Synthetic oligonucleotide
cacaatcagagcattc

SEQ ID NO: 2794 - DNA, 16 bp, Artificial sequence
  Synthetic oligonucleotide
tgatttacaggcccaa

SEQ ID NO: 2795 - DNA, 16 bp, Artificial sequence
  Synthetic oligonucleotide
gtgatttacaggccca

SEQ ID NO: 2796 - DNA, 16 bp, Artificial sequence
  Synthetic oligonucleotide
actaatgacagacaac

SEQ ID NO: 2797 - DNA, 16 bp, Artificial sequence
  Synthetic oligonucleotide
taaactaatgacagac

SEQ ID NO: 2798 - DNA, 16 bp, Artificial sequence
  Synthetic oligonucleotide
ttgaattgtggaccaa

SEQ ID NO: 2799 - DNA, 16 bp, Artificial sequence
  Synthetic oligonucleotide
aggttaatgcttcacc

SEQ ID NO: 2800 - DNA, 16 bp, Artificial sequence
  Synthetic oligonucleotide
tcaaatggtgaccact

SEQ ID NO: 2801 - DNA, 16 bp, Artificial sequence
  Synthetic oligonucleotide
cgttttagttttccta

SEQ ID NO: 2802 - DNA, 16 bp, Artificial sequence
  Synthetic oligonucleotide
gtaataacatgtgtcg

SEQ ID NO: 2803 - DNA, 16 bp, Artificial sequence
  Synthetic oligonucleotide
ggtaataacatgtgtc

SEQ ID NO: 2804 - DNA, 16 bp, Artificial sequence
  Synthetic oligonucleotide
taaacaattgctcatc

SEQ ID NO: 2805 - DNA, 16 bp, Artificial sequence
  Synthetic oligonucleotide
ggtaattctgcaaaga

SEQ ID NO: 2806 - DNA, 16 bp, Artificial sequence
  Synthetic oligonucleotide
taatggtaattctgca

SEQ ID NO: 2807 - DNA, 16 bp, Artificial sequence
  Synthetic oligonucleotide
actaatggtaattctg

SEQ ID NO: 2808 - DNA, 16 bp, Artificial sequence
  Synthetic oligonucleotide
ttagatctcattacct

SEQ ID NO: 2809 - DNA, 16 bp, Artificial sequence
  Synthetic oligonucleotide
gtaacaacatctacct

SEQ ID NO: 2810 - DNA, 16 bp, Artificial sequence
  Synthetic oligonucleotide
ggtaacaacatctacc

SEQ ID NO: 2811 - DNA, 16 bp, Artificial sequence
  Synthetic oligonucleotide
tgatttacaggatgct

SEQ ID NO: 2812 - DNA, 16 bp, Artificial sequence
  Synthetic oligonucleotide
ttgatttacaggatgc

SEQ ID NO: 2813 - DNA, 16 bp, Artificial sequence
  Synthetic oligonucleotide
gcaaatgctggctacg

SEQ ID NO: 2814 - DNA, 16 bp, Artificial sequence
  Synthetic oligonucleotide
cccaatggcaaatgct

SEQ ID NO: 2815 - DNA, 16 bp, Artificial sequence
  Synthetic oligonucleotide
ggcactaccttcacca

SEQ ID NO: 2816 - DNA, 16 bp, Artificial sequence
  Synthetic oligonucleotide
tcatattgttctgccc

SEQ ID NO: 2817 - DNA, 16 bp, Artificial sequence
  Synthetic oligonucleotide
ttcatattgttctgcc

SEQ ID NO: 2818 - DNA, 16 bp, Artificial sequence
  Synthetic oligonucleotide
ggcttttgtcagagga

SEQ ID NO: 2819 - DNA, 16 bp, Artificial sequence
  Synthetic oligonucleotide
ttcaatgacatgctag

SEQ ID NO: 2820 - DNA, 16 bp, Artificial sequence
  Synthetic oligonucleotide
tatatcagctcagtgc

SEQ ID NO: 2821 - DNA, 16 bp, Artificial sequence
  Synthetic oligonucleotide
tatatatcagctcagt

SEQ ID NO: 2822 - DNA, 16 bp, Artificial sequence
  Synthetic oligonucleotide
ttgtatatatcagctc

SEQ ID NO: 2823 - DNA, 16 bp, Artificial sequence
  Synthetic oligonucleotide
tcatacataaggatgt

SEQ ID NO: 2824 - DNA, 16 bp, Artificial sequence
  Synthetic oligonucleotide
gctcattgtaaacagt

SEQ ID NO: 2825 - DNA, 16 bp, Artificial sequence
  Synthetic oligonucleotide
tgcatttggtcttgct

SEQ ID NO: 2826 - DNA, 16 bp, Artificial sequence
  Synthetic oligonucleotide
gactatcagtatgcac

SEQ ID NO: 2827 - DNA, 16 bp, Artificial sequence
  Synthetic oligonucleotide
catcatattggtggga

SEQ ID NO: 2828 - DNA, 16 bp, Artificial sequence
  Synthetic oligonucleotide
gctatattcacaaggc

SEQ ID NO: 2829 - DNA, 16 bp, Artificial sequence
  Synthetic oligonucleotide
ggctatattcacaagg

SEQ ID NO: 2830 - DNA, 16 bp, Artificial sequence
  Synthetic oligonucleotide
aacgattagggactca

SEQ ID NO: 2831 - DNA, 16 bp, Artificial sequence
  Synthetic oligonucleotide
ccctatttgatcagga

SEQ ID NO: 2832 - DNA, 16 bp, Artificial sequence
  Synthetic oligonucleotide
gcaactacctttgtta

SEQ ID NO: 2833 - DNA, 16 bp, Artificial sequence
  Synthetic oligonucleotide
agcaatttcattggcc

SEQ ID NO: 2834 - DNA, 16 bp, Artificial sequence
  Synthetic oligonucleotide
agcaataccttactgg

SEQ ID NO: 2835 - DNA, 16 bp, Artificial sequence
  Synthetic oligonucleotide
tggtatcagggtccca

SEQ ID NO: 2836 - DNA, 16 bp, Artificial sequence
  Synthetic oligonucleotide
catgatgtcgctggca

SEQ ID NO: 2837 - DNA, 16 bp, Artificial sequence
  Synthetic oligonucleotide
tccaaaaatgggctgc

SEQ ID NO: 2838 - DNA, 16 bp, Artificial sequence
  Synthetic oligonucleotide
tctaatcgaagaagct

SEQ ID NO: 2839 - DNA, 16 bp, Artificial sequence
  Synthetic oligonucleotide
tctgattagtccatgc

SEQ ID NO: 2840 - DNA, 16 bp, Artificial sequence
  Synthetic oligonucleotide
acaaatgcggagatga

SEQ ID NO: 2841 - DNA, 16 bp, Artificial sequence
  Synthetic oligonucleotide
gccaatgcaaggtggc

SEQ ID NO: 2842 - DNA, 16 bp, Artificial sequence
  Synthetic oligonucleotide
tgttttggtgctggct

SEQ ID NO: 2843 - DNA, 16 bp, Artificial sequence
  Synthetic oligonucleotide
tggaatggttactctc

SEQ ID NO: 2844 - DNA, 16 bp, Artificial sequence
  Synthetic oligonucleotide
atcttctgcagtgtgg

SEQ ID NO: 2845 - DNA, 16 bp, Artificial sequence
  Synthetic oligonucleotide
ggtatctgggccatca

SEQ ID NO: 2846 - DNA, 16 bp, Artificial sequence
  Synthetic oligonucleotide
agcaacatgaaccaca

SEQ ID NO: 2847 - DNA, 16 bp, Artificial sequence
  Synthetic oligonucleotide
gtaatcaaggcagcaa

SEQ ID NO: 2848 - DNA, 16 bp, Artificial sequence
  Synthetic oligonucleotide
agctctggtttcaaca

SEQ ID NO: 2849 - DNA, 16 bp, Artificial sequence
  Synthetic oligonucleotide
ttaattaagctctggt

SEQ ID NO: 2850 - DNA, 16 bp, Artificial sequence
  Synthetic oligonucleotide
cttaattaagctctgg

SEQ ID NO: 2851 - DNA, 16 bp, Artificial sequence
  Synthetic oligonucleotide
ggcttaattaagctct

SEQ ID NO: 2852 - DNA, 16 bp, Artificial sequence
  Synthetic oligonucleotide
agtgacatagcaagca

SEQ ID NO: 2853 - DNA, 16 bp, Artificial sequence
  Synthetic oligonucleotide
aagaatcagactcttc

SEQ ID NO: 2854 - DNA, 16 bp, Artificial sequence
  Synthetic oligonucleotide
catttataacaggcca

SEQ ID NO: 2855 - DNA, 16 bp, Artificial sequence
  Synthetic oligonucleotide
ccatttataacaggcc

SEQ ID NO: 2856 - DNA, 16 bp, Artificial sequence
  Synthetic oligonucleotide
ggcttatgagtccact

SEQ ID NO: 2857 - DNA, 16 bp, Artificial sequence
  Synthetic oligonucleotide
tgcattaaaactgcga

SEQ ID NO: 2858 - DNA, 16 bp, Artificial sequence
  Synthetic oligonucleotide
aacaatcatagcctca

SEQ ID NO: 2859 - DNA, 16 bp, Artificial sequence
  Synthetic oligonucleotide
aacttactgtctccca

SEQ ID NO: 2860 - DNA, 16 bp, Artificial sequence
  Synthetic oligonucleotide
gtttaataatgtgcag

SEQ ID NO: 2861 - DNA, 16 bp, Artificial sequence
  Synthetic oligonucleotide
ggtttaataatgtgca

SEQ ID NO: 2862 - DNA, 16 bp, Artificial sequence
  Synthetic oligonucleotide
gggtttaataatgtgc

SEQ ID NO: 2863 - DNA, 16 bp, Artificial sequence
  Synthetic oligonucleotide
tcgctaaaggctctga

SEQ ID NO: 2864 - DNA, 16 bp, Artificial sequence
  Synthetic oligonucleotide
tgaaatcagggctccc

SEQ ID NO: 2865 - DNA, 16 bp, Artificial sequence
  Synthetic oligonucleotide
ctctatcacagggccc

SEQ ID NO: 2866 - DNA, 16 bp, Artificial sequence
  Synthetic oligonucleotide
tgctctatcacagggc

SEQ ID NO: 2867 - DNA, 16 bp, Artificial sequence
  Synthetic oligonucleotide
tgtatctggtgactcc

SEQ ID NO: 2868 - DNA, 16 bp, Artificial sequence
  Synthetic oligonucleotide
accgataaatgttgta

SEQ ID NO: 2869 - DNA, 16 bp, Artificial sequence
  Synthetic oligonucleotide
tatagtaacagctggg

SEQ ID NO: 2870 - DNA, 16 bp, Artificial sequence
  Synthetic oligonucleotide
cagtatagtaacagct

SEQ ID NO: 2871 - DNA, 16 bp, Artificial sequence
  Synthetic oligonucleotide
tcagtatagtaacagc

SEQ ID NO: 2872 - DNA, 16 bp, Artificial sequence
  Synthetic oligonucleotide
tgtttaaggactccac

SEQ ID NO: 2873 - DNA, 16 bp, Artificial sequence
  Synthetic oligonucleotide
gacaatttgtttaagg

SEQ ID NO: 2874 - DNA, 16 bp, Artificial sequence
  Synthetic oligonucleotide
gatctaatcagaagca

SEQ ID NO: 2875 - DNA, 16 bp, Artificial sequence
  Synthetic oligonucleotide
tgagattacgcaccac

SEQ ID NO: 2876 - DNA, 16 bp, Artificial sequence
  Synthetic oligonucleotide
attatagggcttctta

SEQ ID NO: 2877 - DNA, 16 bp, Artificial sequence
  Synthetic oligonucleotide
ttattatagggcttct

SEQ ID NO: 2878 - DNA, 16 bp, Artificial sequence
  Synthetic oligonucleotide
tttattatagggcttc

SEQ ID NO: 2879 - DNA, 16 bp, Artificial sequence
  Synthetic oligonucleotide
gtttattatagggctt

SEQ ID NO: 2880 - DNA, 16 bp, Artificial sequence
  Synthetic oligonucleotide
agtgatattcccaaca

SEQ ID NO: 2881 - DNA, 16 bp, Artificial sequence
  Synthetic oligonucleotide
catatatctcctgtta

SEQ ID NO: 2882 - DNA, 16 bp, Artificial sequence
  Synthetic oligonucleotide
tcatatcaccacttgc

SEQ ID NO: 2883 - DNA, 16 bp, Artificial sequence
  Synthetic oligonucleotide
acaatcatatcaccac

SEQ ID NO: 2884 - DNA, 16 bp, Artificial sequence
  Synthetic oligonucleotide
gacaatcatatcacca

SEQ ID NO: 2885 - DNA, 16 bp, Artificial sequence
  Synthetic oligonucleotide
ttatatgtggacacct

SEQ ID NO: 2886 - DNA, 16 bp, Artificial sequence
  Synthetic oligonucleotide
tttatatgtggacacc

SEQ ID NO: 2887 - DNA, 16 bp, Artificial sequence
  Synthetic oligonucleotide
cacaatcccagatctc

SEQ ID NO: 2888 - DNA, 16 bp, Artificial sequence
  Synthetic oligonucleotide
tctataaggttcctta

SEQ ID NO: 2889 - DNA, 16 bp, Artificial sequence
  Synthetic oligonucleotide
tgtttctataaggttc

SEQ ID NO: 2890 - DNA, 16 bp, Artificial sequence
  Synthetic oligonucleotide
ccaaatttagaggaca

SEQ ID NO: 2891 - DNA, 16 bp, Artificial sequence
  Synthetic oligonucleotide
acatatcttgcatgac

SEQ ID NO: 2892 - DNA, 16 bp, Artificial sequence
  Synthetic oligonucleotide
ttagacatcagactgt

SEQ ID NO: 2893 - DNA, 16 bp, Artificial sequence
  Synthetic oligonucleotide
gtcttagacatcagac

SEQ ID NO: 2894 - DNA, 16 bp, Artificial sequence
  Synthetic oligonucleotide
tcaattgaggcttcta

SEQ ID NO: 2895 - DNA, 16 bp, Artificial sequence
  Synthetic oligonucleotide
tgtatctggttcaatt

SEQ ID NO: 2896 - DNA, 16 bp, Artificial sequence
  Synthetic oligonucleotide
gtaaatgtatctggtt

SEQ ID NO: 2897 - DNA, 16 bp, Artificial sequence
  Synthetic oligonucleotide
ggtactgaggctgtgg

SEQ ID NO: 2898 - DNA, 16 bp, Artificial sequence
  Synthetic oligonucleotide
cagaattatcaattcc

SEQ ID NO: 2899 - DNA, 16 bp, Artificial sequence
  Synthetic oligonucleotide
ggtgggtaaaatgtgc

SEQ ID NO: 2900 - DNA, 16 bp, Artificial sequence
  Synthetic oligonucleotide
gcacatagggccttct

SEQ ID NO: 2901 - DNA, 16 bp, Artificial sequence
  Synthetic oligonucleotide
gacaatgtagtttcca

SEQ ID NO: 2902 - DNA, 16 bp, Artificial sequence
  Synthetic oligonucleotide
aactatcccaagctcc

SEQ ID NO: 2903 - DNA, 16 bp, Artificial sequence
  Synthetic oligonucleotide
ggcttcaactatccca

SEQ ID NO: 2904 - DNA, 16 bp, Artificial sequence
  Synthetic oligonucleotide
attgatacagccgttc

SEQ ID NO: 2905 - DNA, 16 bp, Artificial sequence
  Synthetic oligonucleotide
atgataaaggctggca

SEQ ID NO: 2906 - DNA, 16 bp, Artificial sequence
  Synthetic oligonucleotide
aatgataaaggctggc

SEQ ID NO: 2907 - DNA, 16 bp, Artificial sequence
  Synthetic oligonucleotide
aagattatggtttcct

SEQ ID NO: 2908 - DNA, 16 bp, Artificial sequence
  Synthetic oligonucleotide
gaagattatggtttcc

SEQ ID NO: 2909 - DNA, 16 bp, Artificial sequence
  Synthetic oligonucleotide
gtacatggtggagtcc

SEQ ID NO: 2910 - DNA, 16 bp, Artificial sequence
  Synthetic oligonucleotide
tgtattacctacggca

SEQ ID NO: 2911 - DNA, 16 bp, Artificial sequence
  Synthetic oligonucleotide
gctattaatcatattc

SEQ ID NO: 2912 - DNA, 16 bp, Artificial sequence
  Synthetic oligonucleotide
tacttaccaggatctc

SEQ ID NO: 2913 - DNA, 16 bp, Artificial sequence
  Synthetic oligonucleotide
acttatacccagggca

SEQ ID NO: 2914 - DNA, 16 bp, Artificial sequence
  Synthetic oligonucleotide
gacttatacccagggc

SEQ ID NO: 2915 - DNA, 16 bp, Artificial sequence
  Synthetic oligonucleotide
atgaattctggtctgg

SEQ ID NO: 2916 - DNA, 16 bp, Artificial sequence
  Synthetic oligonucleotide
tcaactagccatgtct

SEQ ID NO: 2917 - DNA, 16 bp, Artificial sequence
  Synthetic oligonucleotide
cacttagccacatctg

SEQ ID NO: 2918 - DNA, 16 bp, Artificial sequence
  Synthetic oligonucleotide
ttaatcacttagccac

SEQ ID NO: 2919 - DNA, 16 bp, Artificial sequence
  Synthetic oligonucleotide
accttaatcacttagc

SEQ ID NO: 2920 - DNA, 16 bp, Artificial sequence
  Synthetic oligonucleotide
acaataccttaatcac

SEQ ID NO: 2921 - DNA, 16 bp, Artificial sequence
  Synthetic oligonucleotide
caatttatctggagga

SEQ ID NO: 2922 - DNA, 16 bp, Artificial sequence
  Synthetic oligonucleotide
tcaattagtgttgcct

SEQ ID NO: 2923 - DNA, 16 bp, Artificial sequence
  Synthetic oligonucleotide
atcaattagtgttgcc

SEQ ID NO: 2924 - DNA, 16 bp, Artificial sequence
  Synthetic oligonucleotide
gtcaatcgactggtac

SEQ ID NO: 2925 - DNA, 16 bp, Artificial sequence
  Synthetic oligonucleotide
atatgattcatctcgg

SEQ ID NO: 2926 - DNA, 16 bp, Artificial sequence
  Synthetic oligonucleotide
aatatgattcatctcg

SEQ ID NO: 2927 - DNA, 16 bp, Artificial sequence
  Synthetic oligonucleotide
agctatgagtagcagg

SEQ ID NO: 2928 - DNA, 16 bp, Artificial sequence
  Synthetic oligonucleotide
gccaactaattcctcc

SEQ ID NO: 2929 - DNA, 16 bp, Artificial sequence
  Synthetic oligonucleotide
gccattcacgggctgc

SEQ ID NO: 2930 - DNA, 16 bp, Artificial sequence
  Synthetic oligonucleotide
caagggtacagactta

SEQ ID NO: 2931 - DNA, 16 bp, Artificial sequence
  Synthetic oligonucleotide
ggctggatgtgagtgc

SEQ ID NO: 2932 - DNA, 16 bp, Artificial sequence
  Synthetic oligonucleotide
acaactaacggcaggc

SEQ ID NO: 2933 - DNA, 16 bp, Artificial sequence
  Synthetic oligonucleotide
acacatcagggtttca

SEQ ID NO: 2934 - DNA, 16 bp, Artificial sequence
  Synthetic oligonucleotide
tcctaatggtgactca

SEQ ID NO: 2935 - DNA, 16 bp, Artificial sequence
  Synthetic oligonucleotide
tacaatgtaagccttt

SEQ ID NO: 2936 - DNA, 16 bp, Artificial sequence
  Synthetic oligonucleotide
gtatttcaaagtagtc

SEQ ID NO: 2937 - DNA, 16 bp, Artificial sequence
  Synthetic oligonucleotide
ggttttaatagacaca

SEQ ID NO: 2938 - DNA, 16 bp, Artificial sequence
  Synthetic oligonucleotide
gggttttaatagacac

SEQ ID NO: 2939 - DNA, 16 bp, Artificial sequence
  Synthetic oligonucleotide
gttaacaacaattgtc

SEQ ID NO: 2940 - DNA, 16 bp, Artificial sequence
  Synthetic oligonucleotide
acagatcttgcatgtt

SEQ ID NO: 2941 - DNA, 16 bp, Artificial sequence
  Synthetic oligonucleotide
agctatcacacagaag

SEQ ID NO: 2942 - DNA, 16 bp, Artificial sequence
  Synthetic oligonucleotide
gcaaatccattgccca

SEQ ID NO: 2943 - DNA, 16 bp, Artificial sequence
  Synthetic oligonucleotide
gtgttaaggtggcaac

SEQ ID NO: 2944 - DNA, 16 bp, Artificial sequence
  Synthetic oligonucleotide
ctacatggtgatgggt

SEQ ID NO: 2945 - DNA, 16 bp, Artificial sequence
  Synthetic oligonucleotide
gttagctggactcaca

SEQ ID NO: 2946 - DNA, 16 bp, Artificial sequence
  Synthetic oligonucleotide
caatatcctggtgact

SEQ ID NO: 2947 - DNA, 16 bp, Artificial sequence
  Synthetic oligonucleotide
acacatgcagtgagcc

SEQ ID NO: 2948 - DNA, 16 bp, Artificial sequence
  Synthetic oligonucleotide
tgtatggtggctcagc

SEQ ID NO: 2949 - DNA, 16 bp, Artificial sequence
  Synthetic oligonucleotide
ttgtatggtggctcag

SEQ ID NO: 2950 - DNA, 16 bp, Artificial sequence
  Synthetic oligonucleotide
tgcaatgctgccaggc

SEQ ID NO: 2951 - DNA, 16 bp, Artificial sequence
  Synthetic oligonucleotide
agagatattgatgtct

SEQ ID NO: 2952 - DNA, 16 bp, Artificial sequence
  Synthetic oligonucleotide
gcacattggttaggct

SEQ ID NO: 2953 - DNA, 16 bp, Artificial sequence
  Synthetic oligonucleotide
ctcaatgtgtacagta

SEQ ID NO: 2954 - DNA, 16 bp, Artificial sequence
  Synthetic oligonucleotide
tggaactgtttacagt

SEQ ID NO: 2955 - DNA, 16 bp, Artificial sequence
  Synthetic oligonucleotide
caagtaactgagtcac

SEQ ID NO: 2956 - DNA, 16 bp, Artificial sequence
  Synthetic oligonucleotide
atctatccaaggagga

SEQ ID NO: 2957 - DNA, 16 bp, Artificial sequence
  Synthetic oligonucleotide
tcagttcacggatccc

SEQ ID NO: 2958 - DNA, 16 bp, Artificial sequence
  Synthetic oligonucleotide
tgctttctaaggttgg

SEQ ID NO: 2959 - DNA, 16 bp, Artificial sequence
  Synthetic oligonucleotide
ttttatctgggctcca

SEQ ID NO: 2960 - DNA, 16 bp, Artificial sequence
  Synthetic oligonucleotide
tggaacttttatctgg

SEQ ID NO: 2961 - DNA, 16 bp, Artificial sequence
  Synthetic oligonucleotide
gtgaatggaactttta

SEQ ID NO: 2962 - DNA, 16 bp, Artificial sequence
  Synthetic oligonucleotide
tgtatatgagcccatc

SEQ ID NO: 2963 - DNA, 16 bp, Artificial sequence
  Synthetic oligonucleotide
tcatatccatgcccac

SEQ ID NO: 2964 - DNA, 16 bp, Artificial sequence
  Synthetic oligonucleotide
acaattggtgcctttc

SEQ ID NO: 2965 - DNA, 16 bp, Artificial sequence
  Synthetic oligonucleotide
cacaattggtgccttt

SEQ ID NO: 2966 - DNA, 16 bp, Artificial sequence
  Synthetic oligonucleotide
ggacatcacactcctc

SEQ ID NO: 2967 - DNA, 16 bp, Artificial sequence
  Synthetic oligonucleotide
cgcaatggtgactgcc

SEQ ID NO: 2968 - DNA, 16 bp, Artificial sequence
  Synthetic oligonucleotide
tgaaataccatccacg

SEQ ID NO: 2969 - DNA, 16 bp, Artificial sequence
  Synthetic oligonucleotide
cttgaaataccatcca

SEQ ID NO: 2970 - DNA, 16 bp, Artificial sequence
  Synthetic oligonucleotide
gcctttactgacagct

SEQ ID NO: 2971 - DNA, 16 bp, Artificial sequence
  Synthetic oligonucleotide
acaaatgggtctcgag

SEQ ID NO: 2972 - DNA, 16 bp, Artificial sequence
  Synthetic oligonucleotide
ggttttcacggccagc

SEQ ID NO: 2973 - DNA, 16 bp, Artificial sequence
  Synthetic oligonucleotide
gctatgaaggttttca

SEQ ID NO: 2974 - DNA, 16 bp, Artificial sequence
  Synthetic oligonucleotide
agctatgaaggttttc

SEQ ID NO: 2975 - DNA, 16 bp, Artificial sequence
  Synthetic oligonucleotide
tgtcatatggccaggg

SEQ ID NO: 2976 - DNA, 16 bp, Artificial sequence
  Synthetic oligonucleotide
taatattgtcaccctc

SEQ ID NO: 2977 - DNA, 16 bp, Artificial sequence
  Synthetic oligonucleotide
ataatattgtcaccct

SEQ ID NO: 2978 - DNA, 16 bp, Artificial sequence
  Synthetic oligonucleotide
gtttttgcagctacta

SEQ ID NO: 2979 - DNA, 16 bp, Artificial sequence
  Synthetic oligonucleotide
actatcaaccatctta

SEQ ID NO: 2980 - DNA, 16 bp, Artificial sequence
  Synthetic oligonucleotide
ggacttaatttacaca

SEQ ID NO: 2981 - DNA, 16 bp, Artificial sequence
  Synthetic oligonucleotide
tggacttaatttacac

SEQ ID NO: 2982 - DNA, 16 bp, Artificial sequence
  Synthetic oligonucleotide
gatactaaagtctgga

SEQ ID NO: 2983 - DNA, 16 bp, Artificial sequence
  Synthetic oligonucleotide
gcagatggtggtctac

SEQ ID NO: 2984 - DNA, 16 bp, Artificial sequence
  Synthetic oligonucleotide
gcattttaatattggg

SEQ ID NO: 2985 - DNA, 16 bp, Artificial sequence
  Synthetic oligonucleotide
ggtttaagcgatctcc

SEQ ID NO: 2986 - DNA, 16 bp, Artificial sequence
  Synthetic oligonucleotide
ccaataactgacctca

SEQ ID NO: 2987 - DNA, 16 bp, Artificial sequence
  Synthetic oligonucleotide
accaataactgacctc

SEQ ID NO: 2988 - DNA, 16 bp, Artificial sequence
  Synthetic oligonucleotide
agttattctgatgcca

SEQ ID NO: 2989 - DNA, 16 bp, Artificial sequence
  Synthetic oligonucleotide
gggtatggttgcaacc

SEQ ID NO: 2990 - DNA, 16 bp, Artificial sequence
  Synthetic oligonucleotide
tcattaggacacagcg

SEQ ID NO: 2991 - DNA, 16 bp, Artificial sequence
  Synthetic oligonucleotide
atcattaggacacagc

SEQ ID NO: 2992 - DNA, 16 bp, Artificial sequence
  Synthetic oligonucleotide
tactatcagtacagct

SEQ ID NO: 2993 - DNA, 16 bp, Artificial sequence
  Synthetic oligonucleotide
gatactatcagtacag

SEQ ID NO: 2994 - DNA, 16 bp, Artificial sequence
  Synthetic oligonucleotide
ggagatactatcagta

SEQ ID NO: 2995 - DNA, 16 bp, Artificial sequence
  Synthetic oligonucleotide
tggagatactatcagt

SEQ ID NO: 2996 - DNA, 16 bp, Artificial sequence
  Synthetic oligonucleotide
gtgaacactgatcact

SEQ ID NO: 2997 - DNA, 16 bp, Artificial sequence
  Synthetic oligonucleotide
ggtatatgaggaaaca

SEQ ID NO: 2998 - DNA, 16 bp, Artificial sequence
  Synthetic oligonucleotide
ccgtatatgtctccga

SEQ ID NO: 2999 - DNA, 16 bp, Artificial sequence
  Synthetic oligonucleotide
accgtatatgtctccg

SEQ ID NO: 3000 - DNA, 16 bp, Artificial sequence
  Synthetic oligonucleotide
ggcaattgtctctctt

SEQ ID NO: 3001 - DNA, 16 bp, Artificial sequence
  Synthetic oligonucleotide
tgtataagctcacttt

SEQ ID NO: 3002 - DNA, 16 bp, Artificial sequence
  Synthetic oligonucleotide
catgtataagctcact

SEQ ID NO: 3003 - DNA, 16 bp, Artificial sequence
  Synthetic oligonucleotide
agcatgtataagctca

SEQ ID NO: 3004 - DNA, 16 bp, Artificial sequence
  Synthetic oligonucleotide
ataattatgtcccatc

SEQ ID NO: 3005 - DNA, 16 bp, Artificial sequence
  Synthetic oligonucleotide
gataattatgtcccat

SEQ ID NO: 3006 - DNA, 16 bp, Artificial sequence
  Synthetic oligonucleotide
ggataattatgtccca

SEQ ID NO: 3007 - DNA, 16 bp, Artificial sequence
  Synthetic oligonucleotide
tggataattatgtccc

SEQ ID NO: 3008 - DNA, 16 bp, Artificial sequence
  Synthetic oligonucleotide
atggataattatgtcc

SEQ ID NO: 3009 - DNA, 16 bp, Artificial sequence
  Synthetic oligonucleotide
actactagtttctgtt

SEQ ID NO: 3010 - DNA, 16 bp, Artificial sequence
  Synthetic oligonucleotide
cactactagtttctgt

SEQ ID NO: 3011 - DNA, 16 bp, Artificial sequence
  Synthetic oligonucleotide
ggttatgagattctta

SEQ ID NO: 3012 - DNA, 16 bp, Artificial sequence
  Synthetic oligonucleotide
tggttatgagattctt

SEQ ID NO: 3013 - DNA, 16 bp, Artificial sequence
  Synthetic oligonucleotide
tttattcacagggtcc

SEQ ID NO: 3014 - DNA, 16 bp, Artificial sequence
  Synthetic oligonucleotide
tatttattcacagggt

SEQ ID NO: 3015 - DNA, 16 bp, Artificial sequence
  Synthetic oligonucleotide
gtatttattcacaggg

SEQ ID NO: 3016 - DNA, 16 bp, Artificial sequence
  Synthetic oligonucleotide
gccaatggaaggcacc

SEQ ID NO: 3017 - DNA, 16 bp, Artificial sequence
  Synthetic oligonucleotide
tccatttgggctgtgc

SEQ ID NO: 3018 - DNA, 16 bp, Artificial sequence
  Synthetic oligonucleotide
tgcgatatcctcccct

SEQ ID NO: 3019 - DNA, 16 bp, Artificial sequence
  Synthetic oligonucleotide
gagaataaagcctggc

SEQ ID NO: 3020 - DNA, 16 bp, Artificial sequence
  Synthetic oligonucleotide
gattgaggtaagggtt

SEQ ID NO: 3021 - DNA, 16 bp, Artificial sequence
  Synthetic oligonucleotide
aagtgctattataact

SEQ ID NO: 3022 - DNA, 16 bp, Artificial sequence
  Synthetic oligonucleotide
gaagtgctattataac

SEQ ID NO: 3023 - DNA, 16 bp, Artificial sequence
  Synthetic oligonucleotide
agaagtgctattataa

SEQ ID NO: 3024 - DNA, 16 bp, Artificial sequence
  Synthetic oligonucleotide
aagaagtgctattata

SEQ ID NO: 3025 - DNA, 16 bp, Artificial sequence
  Synthetic oligonucleotide
aaagaagtgctattat

SEQ ID NO: 3026 - DNA, 16 bp, Artificial sequence
  Synthetic oligonucleotide
gaaagaagtgctatta

SEQ ID NO: 3027 - DNA, 16 bp, Artificial sequence
  Synthetic oligonucleotide
ggaaagaagtgctatt

SEQ ID NO: 3028 - DNA, 16 bp, Artificial sequence
  Synthetic oligonucleotide
gggaaagaagtgctat

SEQ ID NO: 3029 - DNA, 16 bp, Artificial sequence
  Synthetic oligonucleotide
agggaaagaagtgcta

SEQ ID NO: 3030 - DNA, 16 bp, Artificial sequence
  Synthetic oligonucleotide
aagggaaagaagtgct

SEQ ID NO: 3031 - DNA, 16 bp, Artificial sequence
  Synthetic oligonucleotide
aaagggaaagaagtgc

SEQ ID NO: 3032 - DNA, 16 bp, Artificial sequence
  Synthetic oligonucleotide
taaaatgtaccccctc

SEQ ID NO: 3033 - DNA, 16 bp, Artificial sequence
  Synthetic oligonucleotide
gaaaagaacaacctgg

SEQ ID NO: 3034 - DNA, 16 bp, Artificial sequence
  Synthetic oligonucleotide
tgcagctgtcagcatg

SEQ ID NO: 3035 - DNA, 16 bp, Artificial sequence
  Synthetic oligonucleotide
atgcagctgtcagcat

SEQ ID NO: 3036 - DNA, 16 bp, Artificial sequence
  Synthetic oligonucleotide
tatgcagctgtcagca

SEQ ID NO: 3037 - DNA, 16 bp, Artificial sequence
  Synthetic oligonucleotide
atatgcagctgtcagc

SEQ ID NO: 3038 - DNA, 16 bp, Artificial sequence
  Synthetic oligonucleotide
gccatatgcagctgtc

SEQ ID NO: 3039 - DNA, 16 bp, Artificial sequence
  Synthetic oligonucleotide
ctttgccatatgcagc

SEQ ID NO: 3040 - DNA, 16 bp, Artificial sequence
  Synthetic oligonucleotide
actttgccatatgcag

SEQ ID NO: 3041 - DNA, 16 bp, Artificial sequence
  Synthetic oligonucleotide
tactttgccatatgca

SEQ ID NO: 3042 - DNA, 16 bp, Artificial sequence
  Synthetic oligonucleotide
ttactttgccatatgc

SEQ ID NO: 3043 - DNA, 16 bp, Artificial sequence
  Synthetic oligonucleotide
gttactttgccatatg

SEQ ID NO: 3044 - DNA, 16 bp, Artificial sequence
  Synthetic oligonucleotide
ggttactttgccatat

SEQ ID NO: 3045 - DNA, 16 bp, Artificial sequence
  Synthetic oligonucleotide
attgaggtaagggtta

SEQ ID NO: 3046 - DNA, 16 bp, Artificial sequence
  Synthetic oligonucleotide
tatcttgattgaggta

SEQ ID NO: 3047 - DNA, 16 bp, Artificial sequence
  Synthetic oligonucleotide
gtatcttgattgaggt

SEQ ID NO: 3048 - DNA, 16 bp, Artificial sequence
  Synthetic oligonucleotide
tgtatcttgattgagg

SEQ ID NO: 3049 - DNA, 16 bp, Artificial sequence
  Synthetic oligonucleotide
ctgtatcttgattgag

SEQ ID NO: 3050 - DNA, 16 bp, Artificial sequence
  Synthetic oligonucleotide
cgctctgtatcttgat

SEQ ID NO: 3051 - DNA, 16 bp, Artificial sequence
  Synthetic oligonucleotide
ccgctctgtatcttga

SEQ ID NO: 3052 - DNA, 16 bp, Artificial sequence
  Synthetic oligonucleotide
tttaggaggtgacgga

SEQ ID NO: 3053 - DNA, 16 bp, Artificial sequence
  Synthetic oligonucleotide
ttttaggaggtgacgg

SEQ ID NO: 3054 - DNA, 16 bp, Artificial sequence
  Synthetic oligonucleotide
attttaggaggtgacg

SEQ ID NO: 3055 - DNA, 16 bp, Artificial sequence
  Synthetic oligonucleotide
gattttaggaggtgac

SEQ ID NO: 3056 - DNA, 16 bp, Artificial sequence
  Synthetic oligonucleotide
ggattttaggaggtga

SEQ ID NO: 3057 - DNA, 16 bp, Artificial sequence
  Synthetic oligonucleotide
gggattttaggaggtg

SEQ ID NO: 3058 - DNA, 16 bp, Artificial sequence
  Synthetic oligonucleotide
agggattttaggaggt

SEQ ID NO: 3059 - DNA, 16 bp, Artificial sequence
  Synthetic oligonucleotide
cagggattttaggagg

SEQ ID NO: 3060 - DNA, 16 bp, Artificial sequence
  Synthetic oligonucleotide
acagggattttaggag

SEQ ID NO: 3061 - DNA, 16 bp, Artificial sequence
  Synthetic oligonucleotide
cagctgtcagcatgat

SEQ ID NO: 3062 - DNA, 16 bp, Artificial sequence
  Synthetic oligonucleotide
gcagctgtcagcatga

SEQ ID NO: 3063 - DNA, 16 bp, Artificial sequence
  Synthetic oligonucleotide
cggtggccatggaggg

SEQ ID NO: 3064 - DNA, 16 bp, Artificial sequence
  Synthetic oligonucleotide
ccggtggccatggagg

SEQ ID NO: 3065 - DNA, 16 bp, Artificial sequence
  Synthetic oligonucleotide
cccggtggccatggag

SEQ ID NO: 3066 - DNA, 16 bp, Artificial sequence
  Synthetic oligonucleotide
gcccggtggccatgga

SEQ ID NO: 3067 - DNA, 16 bp, Artificial sequence
  Synthetic oligonucleotide
ggcccggtggccatgg

SEQ ID NO: 3068 - DNA, 16 bp, Artificial sequence
  Synthetic oligonucleotide
gggcccggtggccatg

SEQ ID NO: 3069 - DNA, 16 bp, Artificial sequence
  Synthetic oligonucleotide
agagcataggagaggg

SEQ ID NO: 3070 - DNA, 16 bp, Artificial sequence
  Synthetic oligonucleotide
gcagagcataggagag

SEQ ID NO: 3071 - DNA, 16 bp, Artificial sequence
  Synthetic oligonucleotide
gagcagagcataggag

SEQ ID NO: 3072 - DNA, 16 bp, Artificial sequence
  Synthetic oligonucleotide
ggagcagagcatagga

SEQ ID NO: 3073 - DNA, 16 bp, Artificial sequence
  Synthetic oligonucleotide
agggagcagagcatag

SEQ ID NO: 3074 - DNA, 16 bp, Artificial sequence
  Synthetic oligonucleotide
ggagggagcagagcat

SEQ ID NO: 3075 - DNA, 16 bp, Artificial sequence
  Synthetic oligonucleotide
atggagggagcagagc

SEQ ID NO: 3076 - DNA, 16 bp, Artificial sequence
  Synthetic oligonucleotide
atcctgttatatcttt

SEQ ID NO: 3077 - DNA, 16 bp, Artificial sequence
  Synthetic oligonucleotide
aatcctgttatatctt

SEQ ID NO: 3078 - DNA, 16 bp, Artificial sequence
  Synthetic oligonucleotide
caccaggatctccccc

SEQ ID NO: 3079 - DNA, 16 bp, Artificial sequence
  Synthetic oligonucleotide
gatcaccaggatctcc

SEQ ID NO: 3080 - DNA, 16 bp, Artificial sequence
  Synthetic oligonucleotide
gcttctcggcacactt

SEQ ID NO: 3081 - DNA, 16 bp, Artificial sequence
  Synthetic oligonucleotide
agcttctcggcacact

SEQ ID NO: 3082 - DNA, 16 bp, Artificial sequence
  Synthetic oligonucleotide
tgagcttctcggcaca

SEQ ID NO: 3083 - DNA, 16 bp, Artificial sequence
  Synthetic oligonucleotide
aggaactgagcttctc

SEQ ID NO: 3084 - DNA, 16 bp, Artificial sequence
  Synthetic oligonucleotide
taggaactgagcttct

SEQ ID NO: 3085 - DNA, 16 bp, Artificial sequence
  Synthetic oligonucleotide
ttttggacttgcagtg

SEQ ID NO: 3086 - DNA, 16 bp, Artificial sequence
  Synthetic oligonucleotide
acttcaaactcggctc

SEQ ID NO: 3087 - DNA, 16 bp, Artificial sequence
  Synthetic oligonucleotide
aactgtattgattagc

SEQ ID NO: 3088 - DNA, 16 bp, Artificial sequence
  Synthetic oligonucleotide
gtgtggttaatatggc

SEQ ID NO: 3089 - DNA, 16 bp, Artificial sequence
  Synthetic oligonucleotide
atagaatacagagtgc

SEQ ID NO: 3090 - DNA, 16 bp, Artificial sequence
  Synthetic oligonucleotide
tagtcggttgtctgga

SEQ ID NO: 3091 - DNA, 16 bp, Artificial sequence
  Synthetic oligonucleotide
gatagtcggttgtctg

SEQ ID NO: 3092 - DNA, 16 bp, Artificial sequence
  Synthetic oligonucleotide
tgatagtcggttgtct

SEQ ID NO: 3093 - DNA, 16 bp, Artificial sequence
  Synthetic oligonucleotide
ttgatagtcggttgtc

SEQ ID NO: 3094 - DNA, 16 bp, Artificial sequence
  Synthetic oligonucleotide
agttgatagtcggttg

SEQ ID NO: 3095 - DNA, 16 bp, Artificial sequence
  Synthetic oligonucleotide
gagttgatagtcggtt

SEQ ID NO: 3096 - DNA, 16 bp, Artificial sequence
  Synthetic oligonucleotide
cgagttgatagtcggt

SEQ ID NO: 3097 - DNA, 16 bp, Artificial sequence
  Synthetic oligonucleotide
agcgagttgatagtcg

SEQ ID NO: 3098 - DNA, 16 bp, Artificial sequence
  Synthetic oligonucleotide
gtattatggtatgtga

SEQ ID NO: 3099 - DNA, 16 bp, Artificial sequence
  Synthetic oligonucleotide
taggtattatggtatg

SEQ ID NO: 3100 - DNA, 16 bp, Artificial sequence
  Synthetic oligonucleotide
ttaggtattatggtat

SEQ ID NO: 3101 - DNA, 16 bp, Artificial sequence
  Synthetic oligonucleotide
attaggtattatggta

SEQ ID NO: 3102 - DNA, 16 bp, Artificial sequence
  Synthetic oligonucleotide
ggattaggtattatgg

SEQ ID NO: 3103 - DNA, 16 bp, Artificial sequence
  Synthetic oligonucleotide
ttggactgttttcccc

SEQ ID NO: 3104 - DNA, 16 bp, Artificial sequence
  Synthetic oligonucleotide
gtttggactgttttcc

SEQ ID NO: 3105 - DNA, 16 bp, Artificial sequence
  Synthetic oligonucleotide
gatgtgtttcctgtgt

SEQ ID NO: 3106 - DNA, 16 bp, Artificial sequence
  Synthetic oligonucleotide
tgatgtgtttcctgtg

SEQ ID NO: 3107 - DNA, 16 bp, Artificial sequence
  Synthetic oligonucleotide
atgatgtgtttcctgt

SEQ ID NO: 3108 - DNA, 16 bp, Artificial sequence
  Synthetic oligonucleotide
agatgatgtgtttcct

SEQ ID NO: 3109 - DNA, 16 bp, Artificial sequence
  Synthetic oligonucleotide
cagatgatgtgtttcc

SEQ ID NO: 3110 - DNA, 16 bp, Artificial sequence
  Synthetic oligonucleotide
acagatgatgtgtttc

SEQ ID NO: 3111 - DNA, 16 bp, Artificial sequence
  Synthetic oligonucleotide
atacagatgatgtgtt

SEQ ID NO: 3112 - DNA, 16 bp, Artificial sequence
  Synthetic oligonucleotide
tttttgagaggttgac

SEQ ID NO: 3113 - DNA, 16 bp, Artificial sequence
  Synthetic oligonucleotide
tatagggcttcttatc

SEQ ID NO: 3114 - DNA, 16 bp, Artificial sequence
  Synthetic oligonucleotide
ttatagggcttcttat

SEQ ID NO: 3115 - DNA, 16 bp, Artificial sequence
  Synthetic oligonucleotide
agtttattatagggct

SEQ ID NO: 3116 - DNA, 16 bp, Artificial sequence
  Synthetic oligonucleotide
aagtttattatagggc

SEQ ID NO: 3117 - DNA, 16 bp, Artificial sequence
  Synthetic oligonucleotide
taagtttattataggg

SEQ ID NO: 3118 - DNA, 16 bp, Artificial sequence
  Synthetic oligonucleotide
gtaagtttattatagg

SEQ ID NO: 3119 - DNA, 16 bp, Artificial sequence
  Synthetic oligonucleotide
agtaagtttattatag

SEQ ID NO: 3120 - DNA, 16 bp, Artificial sequence
  Synthetic oligonucleotide
atgtatctggttcaat

SEQ ID NO: 3121 - DNA, 16 bp, Artificial sequence
  Synthetic oligonucleotide
aatgtatctggttcaa

SEQ ID NO: 3122 - DNA, 16 bp, Artificial sequence
  Synthetic oligonucleotide
aaatgtatctggttca

SEQ ID NO: 3123 - DNA, 16 bp, Artificial sequence
  Synthetic oligonucleotide
taaatgtatctggttc

SEQ ID NO: 3124 - DNA, 16 bp, Artificial sequence
  Synthetic oligonucleotide
aagtaaatgtatctgg

SEQ ID NO: 3125 - DNA, 16 bp, Artificial sequence
  Synthetic oligonucleotide
caagtaaatgtatctg

SEQ ID NO: 3126 - DNA, 16 bp, Artificial sequence
  Synthetic oligonucleotide
acaagtaaatgtatct

SEQ ID NO: 3127 - DNA, 16 bp, Artificial sequence
  Synthetic oligonucleotide
aacaagtaaatgtatc

SEQ ID NO: 3128 - DNA, 16 bp, Artificial sequence
  Synthetic oligonucleotide
ttctggtctggcttaa

SEQ ID NO: 3129 - DNA, 16 bp, Artificial sequence
  Synthetic oligonucleotide
aattctggtctggctt

SEQ ID NO: 3130 - DNA, 16 bp, Artificial sequence
  Synthetic oligonucleotide
tgaattctggtctggc

SEQ ID NO: 3131 - DNA, 16 bp, Artificial sequence
  Synthetic oligonucleotide
aatgaattctggtctg

SEQ ID NO: 3132 - DNA, 16 bp, Artificial sequence
  Synthetic oligonucleotide
gaatgaattctggtct

SEQ ID NO: 3133 - DNA, 16 bp, Artificial sequence
  Synthetic oligonucleotide
agaatgaattctggtc

SEQ ID NO: 3134 - DNA, 16 bp, Artificial sequence
  Synthetic oligonucleotide
caagaatgaattctgg

SEQ ID NO: 3135 - DNA, 3684 bp, Homo sapien
gaggtcgctcgggtcgggtgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccgggacttccttccccgcggttcaggaatcgtcacccggcggcctctcattctgcagctcatcttctcaaaaacagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacgtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggcctacggaccatcggtgtcatcaccaagcttgacctgatggacgagggcaccgacgccagggacgtcttggagaacaagttgctcccgttgagaagaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagatggtccagcagtttggggtggattttgagaagaggatcgagggctcaggagatcaggtggacactctggagctctccgggggcgcccgaatcaatcgcatcttccacgagcggttcccatttgagctggtgaagatggagtttgacgagaaggacttacgacgggagatcagctatgccattaagaacatccatggagtcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaagctcagttcctacccccggttgcgagaggagacagagcgaatcgtcaccacttacatccgggaacgggaggggagaacgaaggaccagattcttctgctgatcgacattgagcagtcctacatcaacacgaaccatgaggacttcatcgggtttgccaatgcccagcagaggagcacgcagctgaacaagaagagagccatccccaatcagggggagatcctggtgatccgcaggggctggctgaccatcaacaacatcagcctgatgaaaggcggctccaaggagtactggtttgtgctgactgccgagtcactgtcctggtacaaggatgaggaggagaaagagaagaagtacatgctgcctctggacaacctcaagatccgtgatgtggagaagggcttcatgtccaacaagcacgtcttcgccatcttcaacacggagcagagaaacgtctacaaggacctgcggcagatcgagctggcctgtgactcccaggaagacgtggacagctggaaggcctcgttcctccgagctggcgtctaccccgagaaggaccaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtggctgctgaaaaaaaaaaaaaaaaaa

What is claimed:

1. A compound comprising a modified oligonucleotide consisting of 16 to 20 linked nucleosides and having a nucleobase sequence comprising at least 14 contiguous nucleobases of SEQ ID NO: 2879 or SEQ ID NO: 2123, wherein the modified oligonucleotide comprises at least one of a modified internucleoside linkage and a modified sugar moiety.

2. The compound of claim 1, wherein the nucleobase sequence comprises SEQ ID NO: 2879.

3. The compound of claim 1, wherein the nucleobase sequence comprises SEQ ID NO: 2123.

4. The compound of claim 1, wherein the nucleobase sequence is SEQ ID NO: 2879 or 2123.

5. The compound of claim 1, wherein the modified oligonucleotide comprises:
- a gap segment consisting of 8-12 linked 2'-deoxynucleosides;
- a 5' wing segment consisting of 1-7 linked nucleosides; and
- a 3' wing segment consisting of 1-7 linked nucleosides;
- wherein the gap segment is positioned between the 5' wing segment and the 3' wing segment and wherein the terminal nucleoside of each wing segment comprises a modified sugar.

6. The compound of claim 1, wherein the modified oligonucleotide comprises:
- a gap segment consisting of 10 linked 2'-deoxynucleosides;
- a 5' wing segment consisting of 3 linked nucleosides; and
- a 3' wing segment consisting of 3 linked nucleosides;
- wherein the gap segment is positioned between the 5' wing segment and the 3' wing segment; wherein each nucleoside of each wing segment comprises a cEt sugar moiety; wherein each internucleoside linkage is a phosphorothioate linkage; and wherein each cytosine is a 5-methylcytosine.

7. The compound of claim 1, wherein the modified internucleoside linkage is a phosphorothioate internucleoside linkage.

8. The compound of claim 1, wherein the modified sugar moiety is a bicyclic sugar.

9. The compound of claim 8, wherein the bicyclic sugar is selected from the group consisting of LNA, ENA, and cEt.

10. The compound of claim 1, wherein the modified oligonucleotide comprises at least one 5-methylcytosine.

11. The compound of claim 1, wherein the modified oligonucleotide is single-stranded.

12. The compound of claim 1, wherein the compound is a double-stranded compound.

13. The compound of claim 1, comprising a conjugate group.

14. The compound of claim 13, wherein the compound consists of the modified oligonucleotide and the conjugate group.

15. A modified oligonucleotide according to the following formula: Gks Tks Tks Tds Ads Tds Tds Ads Tds Ads Gds Gds Gds mCks Tks Tk; wherein,
- A=an adenine nucleobase,
- mC=a 5-methylcytosine nucleobase,
- G=a guanine nucleobase,
- T=a thymine nucleobase,
- k=a cEt sugar moiety,
- d=a 2'-deoxyribosyl sugar moiety, and
- s=a phosphorothioate internucleoside linkage.

16. A modified oligonucleotide, wherein the anion form of the modified oligonucleotide has the following chemical structure:

281 282
(SEQ ID NO: 2879)
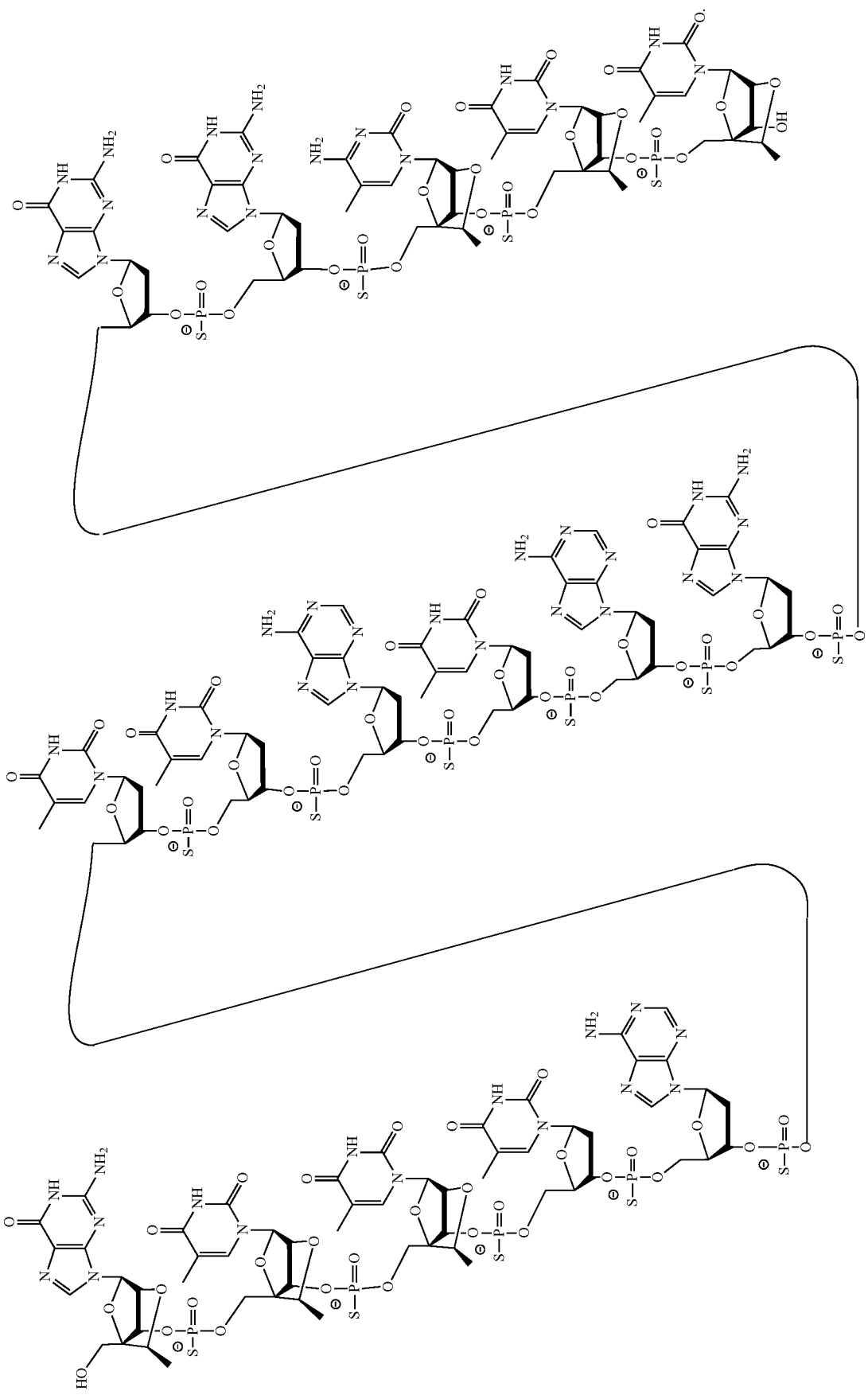

17. The modified oligonucleotide of claim 16, wherein the modified oligonucleotide is a salt.

18. The modified oligonucleotide of claim 17, wherein the cation of the salt is a sodium or a potassium.

19. A chirally enriched population of the compound of claim 1, wherein the population is enriched for compounds having a modified oligonucleotide comprising at least one particular phosphorothioate internucleoside linkage having a particular stereochemical configuration.

20. A pharmaceutical composition comprising the modified oligonucleotide of claim 16, and at least one pharmaceutically acceptable diluent or carrier.

21. A method of treating, preventing, or ameliorating centronuclear myopathy, Duchenne Muscular Dystrophy, or Charcot-Marie Tooth disease, the method comprising administering the compound of claim 1 to a subject with a mutation in at least one gene selected from among MTM1, BIN1, and DNM2.

22. An in vitro method of inhibiting expression of DNM2 in a cell comprising contacting the cell with compound comprising a single-stranded modified oligonucleotide that is 100% complementary to exon 10, intron 1, intron 11, intron 12, intron 13, intron 14, or the 3'-UTR of a DNM2 nucleic acid transcript, thereby inhibiting expression of DNM2 in the cell.

23. The in vitro method of claim 22, wherein the modified oligonucleotide consists of 16 to 20 linked nucleosides and has a nucleobase sequence comprising at least 14 contiguous nucleobases of SEQ ID NO: 2879 or SEQ ID NO: 2123, wherein the modified oligonucleotide comprises at least one of a modified internucleoside linkage and a modified sugar moiety.

24. The in vitro method of claim 22, wherein the modified oligonucleotide is according to the following formula: Gks Tks Tks Tds Ads Tds Tds Ads Tds Ads Gds Gds Gds mCks Tks Tk; wherein,
A=an adenine nucleobase,
mC=a 5-methylcytosine nucleobase,
G=a guanine nucleobase,
T=a thymine nucleobase,
k=a cEt sugar moiety,
d=a 2'-deoxyribosyl sugar moiety, and
s=a phosphorothioate internucleoside linkage.

25. The in vitro method of claim 22, wherein the anion form of the modified oligonucleotide has the following chemical structure:

287 288
(SEQ ID NO: 2879)
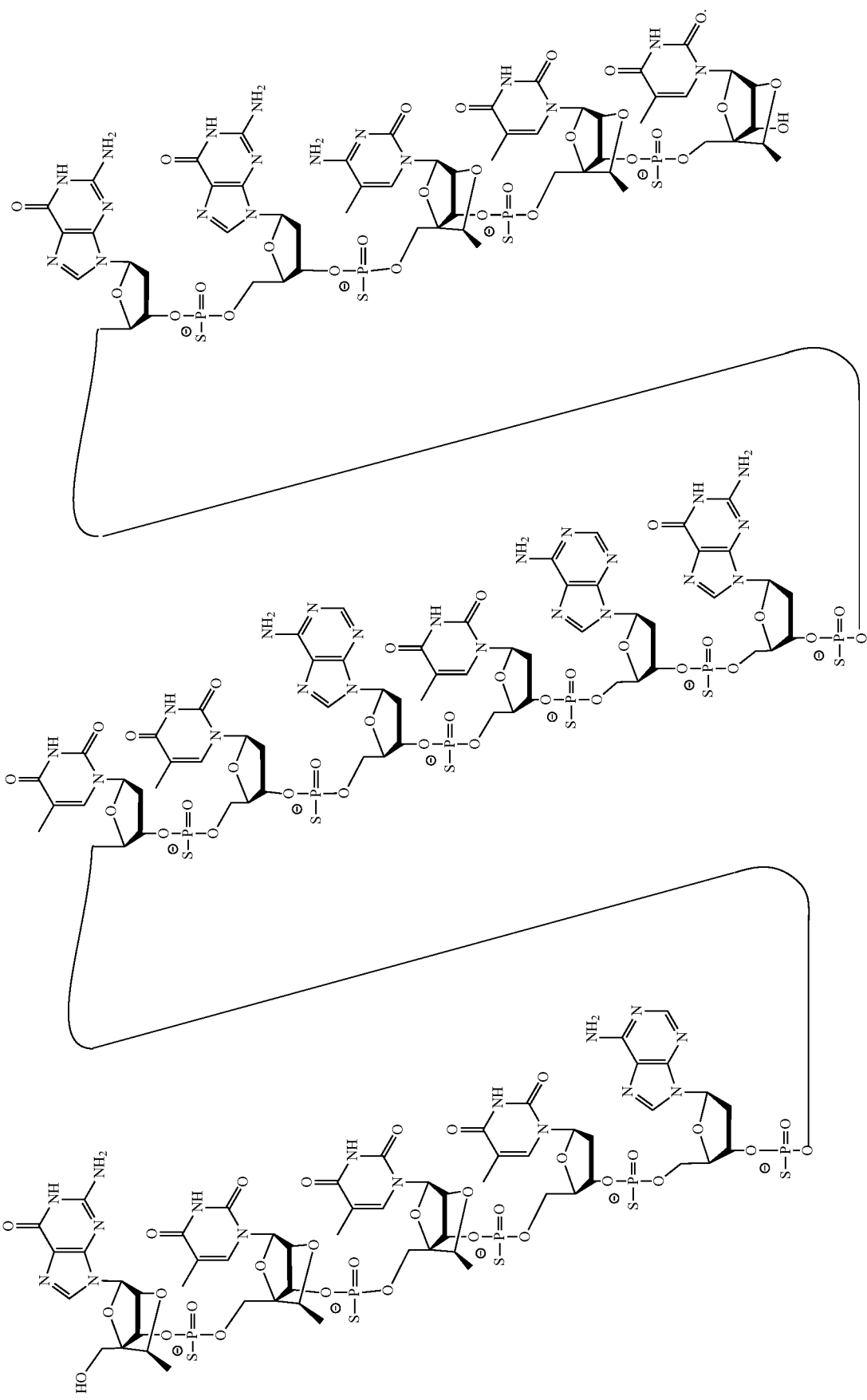

26. The in vitro method of claim 22, wherein the modified oligonucleotide has the following chemical structure:

293 294
(SEQ ID NO: 2879)
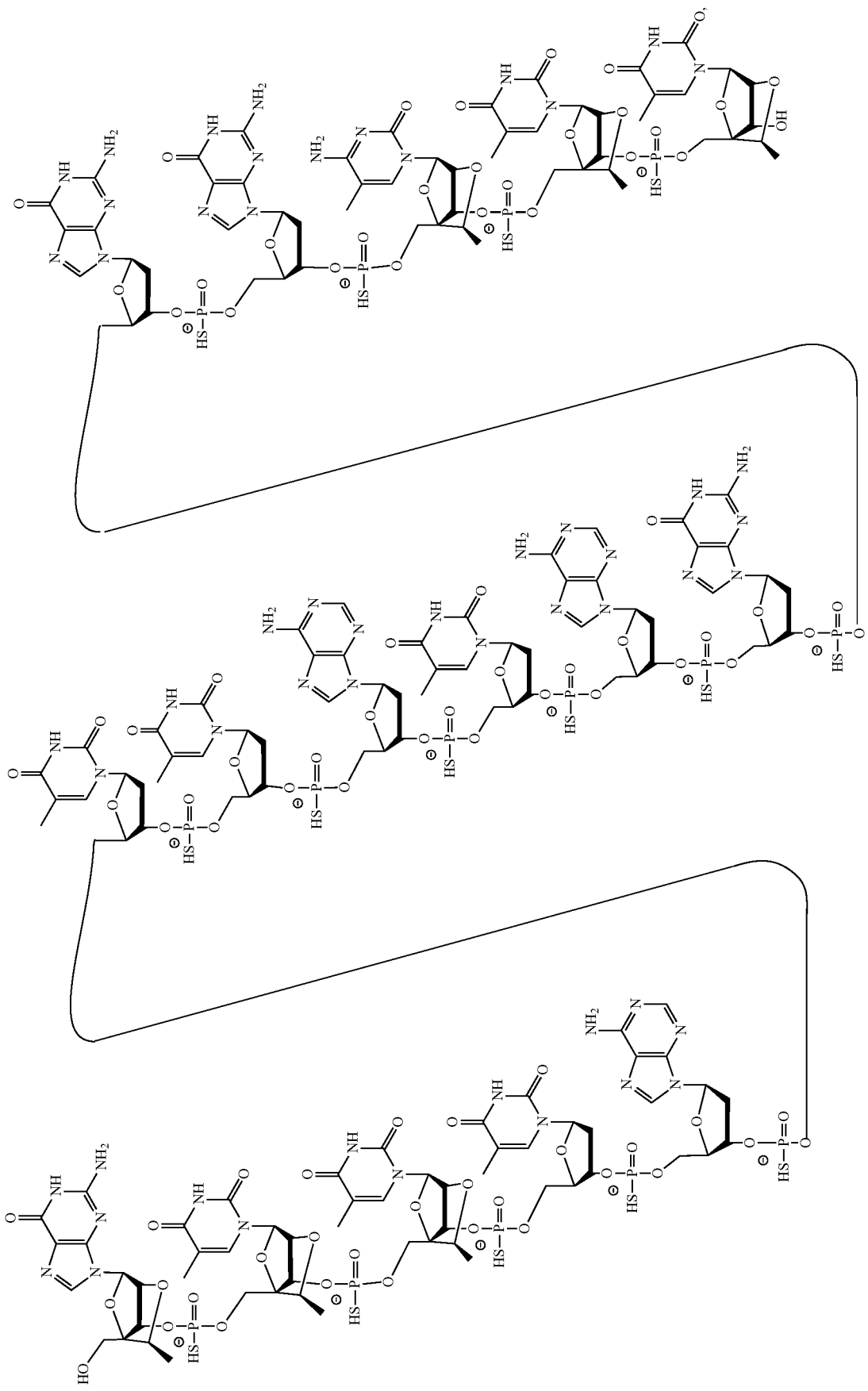

or a salt thereof.

27. The in vitro method of claim 22, wherein the modified oligonucleotide has the following chemical structure:

299 300
(SEQ ID NO: 2879)
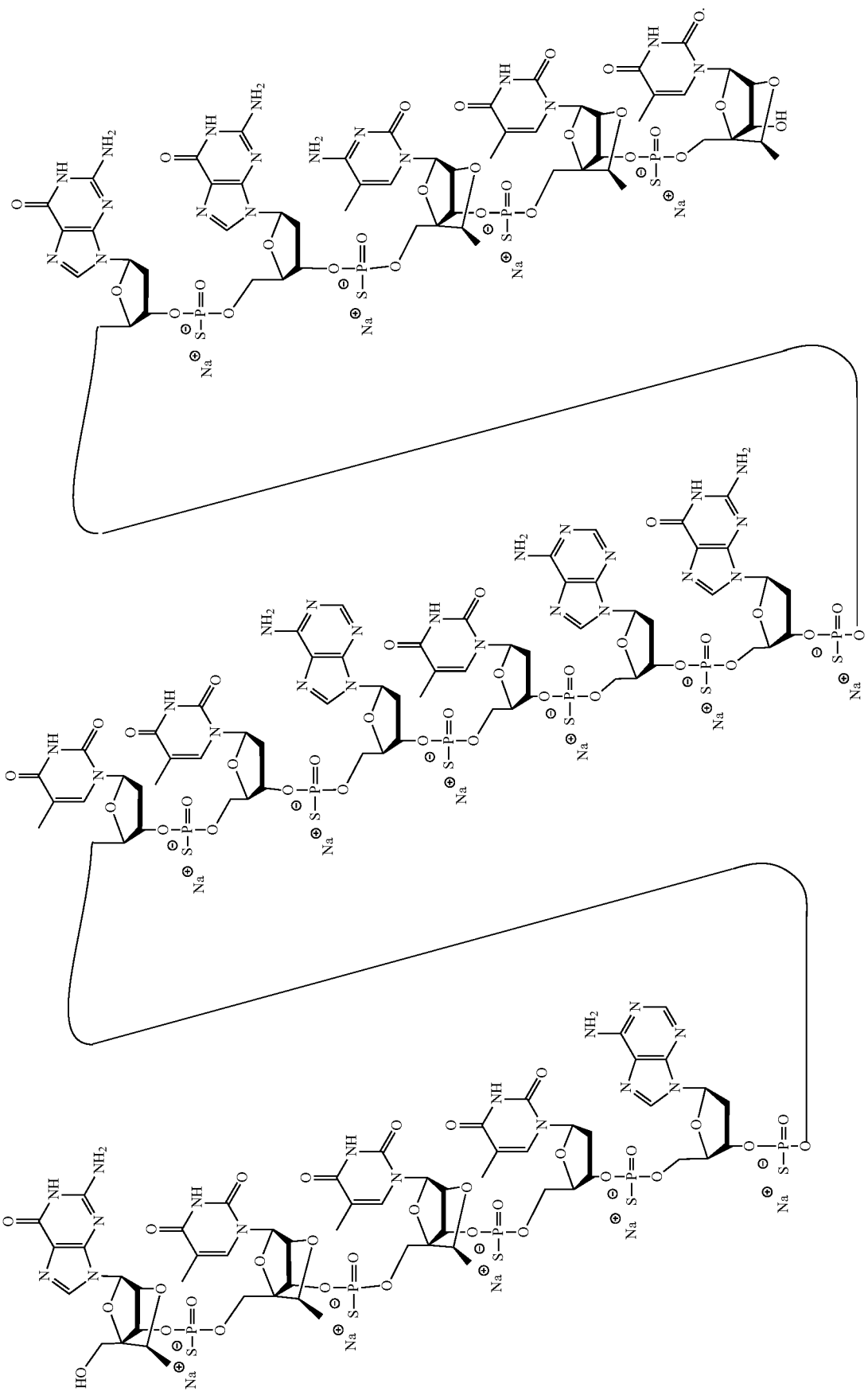

28. The pharmaceutical composition of claim 20, wherein the pharmaceutically acceptable diluent is phosphate buffered saline.

29. A chirally enriched population of the modified oligonucleotide of claim 15, wherein the population is enriched for modified oligonucleotides comprising at least one particular phosphorothioate internucleoside linkage having a particular stereochemical configuration.

30. A chirally enriched population of the modified oligonucleotide of claim 16, wherein the population is enriched for modified oligonucleotides comprising at least one particular phosphorothioate internucleoside linkage having a particular stereochemical configuration.

31. A pharmaceutical composition comprising the modified oligonucleotide of claim 15, and at least one pharmaceutically acceptable diluent or carrier.

32. The pharmaceutical composition of claim 31, wherein the pharmaceutically acceptable diluent is phosphate buffered saline.

33. A method of treating or ameliorating centronuclear myopathy, Duchenne Muscular Dystrophy, or Charcot-Marie Tooth disease, the method comprising administering the modified oligonucleotide of claim 15 to a subject with a mutation in at least one gene selected from among MTM1, BIN1, and DNM2.

34. A method of treating or ameliorating centronuclear myopathy, Duchenne Muscular Dystrophy, or Charcot-Marie Tooth disease, the method comprising administering the modified oligonucleotide of claim 16 to a subject with a mutation in at least one gene selected from among MTM1, BIN1, and DNM2.

35. The modified oligonucleotide of claim 15, comprising the modified oligonucleotide covalently linked to a conjugate group.

36. A modified oligonucleotide according to the following chemical structure:

305 306
(SEQ ID NO: 2879)
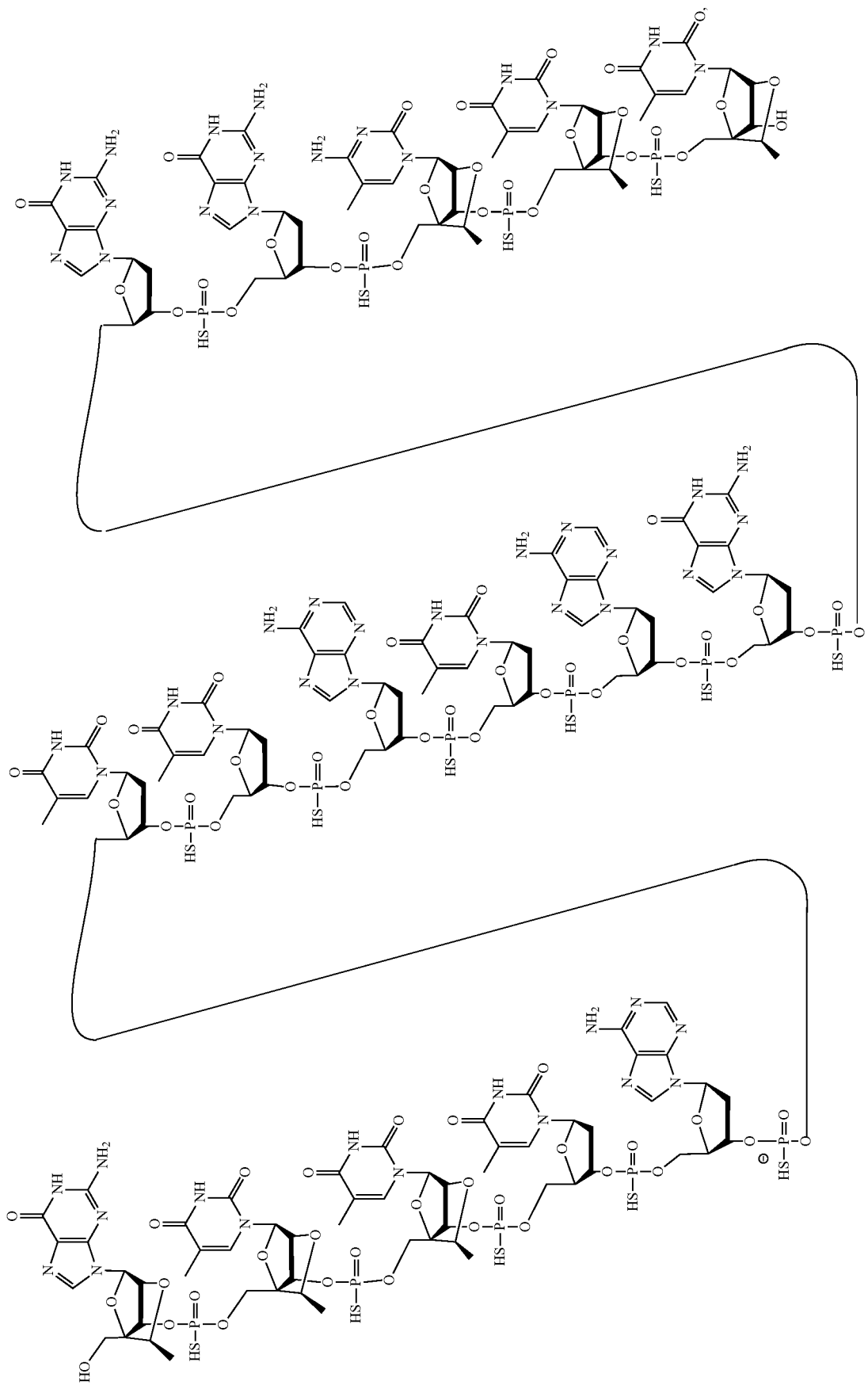

or a salt thereof.

37. The modified oligonucleotide of claim 36, which is the sodium salt or the potassium salt.

38. A chirally enriched population of the modified oligonucleotide of claim 36, wherein the population is enriched for modified oligonucleotides comprising at least one particular phosphorothioate internucleoside linkage having a particular stereochemical configuration.

39. A pharmaceutical composition comprising the modified oligonucleotide of claim 36 and at least one pharmaceutically acceptable diluent or carrier.

40. The pharmaceutical composition of claim 39, wherein the pharmaceutically acceptable diluent is phosphate buffered saline.

41. A method of treating or ameliorating centronuclear myopathy, Duchenne Muscular Dystrophy, or Charcot-Marie Tooth disease, the method comprising administering the modified oligonucleotide of claim 36 to a subject with a mutation in at least one gene selected from among MTM1, BIN1, and DNM2.

42. A modified oligonucleotide according to the following chemical structure:

311 312
(SEQ ID NO: 2879)
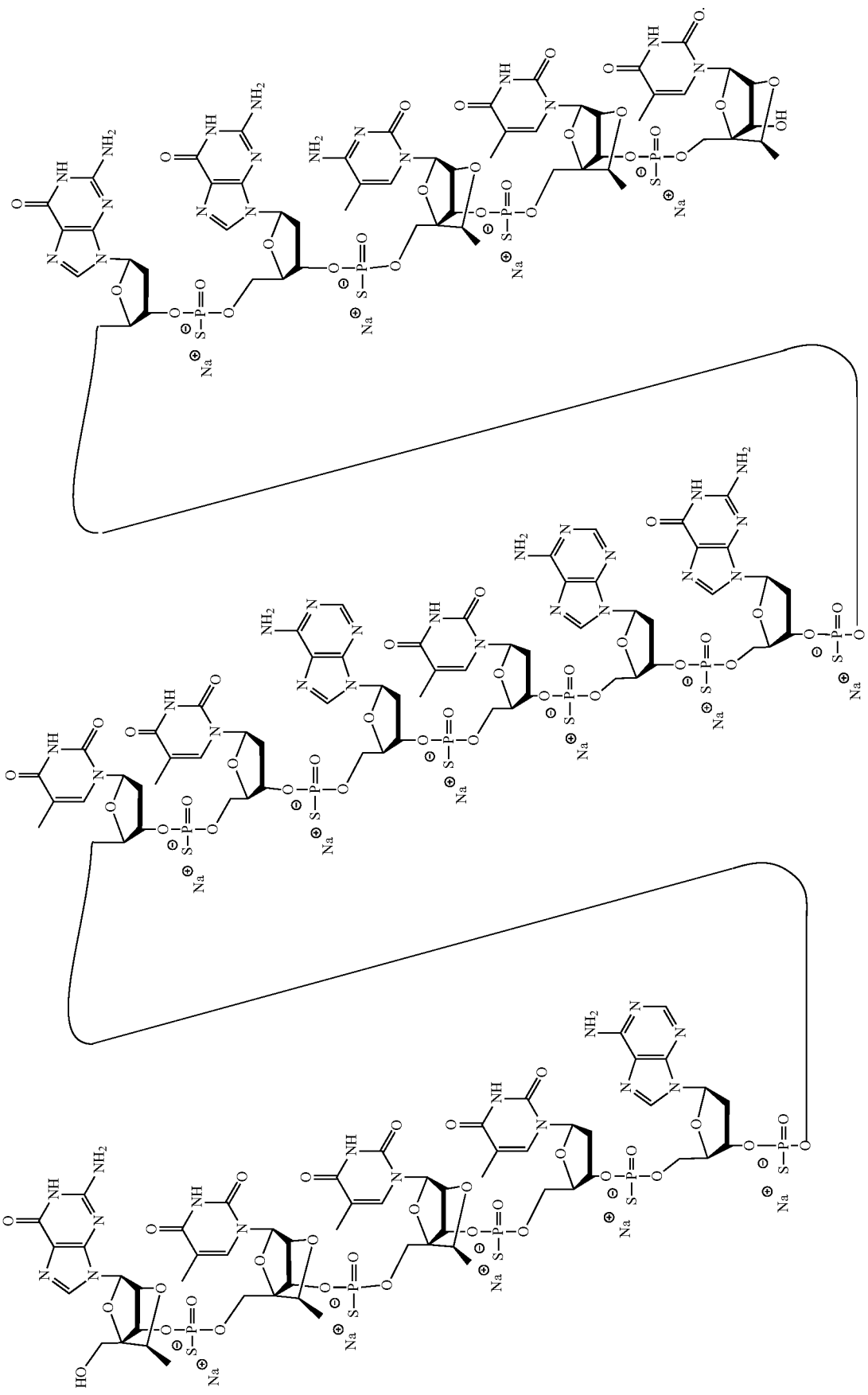

43. A chirally enriched population of the modified oligonucleotide of claim 42, wherein the population is enriched for modified oligonucleotides comprising at least one particular phosphorothioate internucleoside linkage having a particular stereochemical configuration.

44. A pharmaceutical composition comprising the modified oligonucleotide of claim 42 and at least one pharmaceutically acceptable diluent or carrier.

45. The pharmaceutical composition of claim 44, wherein the pharmaceutically acceptable diluent is phosphate buffered saline.

46. A method of treating or ameliorating centronuclear myopathy, Duchenne Muscular Dystrophy, or Charcot-Marie Tooth disease, the method comprising administering the modified oligonucleotide of claim 42 to a subject with a mutation in at least one gene selected from among MTM1, BIN1, and DNM2.

47. The pharmaceutical composition of claim 32, consisting essentially of the modified oligonucleotide and phosphate buffered saline.

48. The pharmaceutical composition of claim 40, consisting essentially of the modified oligonucleotide and phosphate buffered saline.

49. The pharmaceutical composition of claim 45, consisting essentially of the modified oligonucleotide and phosphate buffered saline.

* * * * *